US012799224B2

(12) United States Patent
Raum et al.

(10) Patent No.: US 12,799,224 B2
(45) Date of Patent: Nov. 17, 2026

(54) BISPECIFIC T CELL ENGAGING ANTIBODY CONSTRUCTS

(71) Applicant: AMGEN RESEARCH (MUNICH) GMBH, Munich (DE)

(72) Inventors: Tobias Raum, Munich (DE); Markus Münz, Munich (DE); Johannes Brozy, Munich (DE); Peter Kufer, Munich (DE); Patrick Hoffmann, Munich (DE); Matthias Friedrich, Munich (DE); Benno Rattel, Munich (DE); Pamela Bogner, Munich (DE); Andreas Wolf, Munich (DE); Cornelius Pompe, Munich (DE)

(73) Assignee: Amgen Research (Munich) GmbH, Munich (DE)

(*) Notice: Subject to any disclaimer, the term of this patent is extended or adjusted under 35 U.S.C. 154(b) by 0 days.

(21) Appl. No.: 17/812,061

(22) Filed: Jul. 12, 2022

(65) Prior Publication Data

US 2023/0192884 A1 Jun. 22, 2023

Related U.S. Application Data

(62) Division of application No. 15/422,647, filed on Feb. 2, 2017, now Pat. No. 11,434,302.

(Continued)

(51) Int. Cl.

*C07K 16/30* (2006.01)
*A61K 39/395* (2006.01)

(Continued)

(52) U.S. Cl.

CPC ........ *C07K 16/30* (2013.01); *A61K 39/39558* (2013.01); *C07K 16/28* (2013.01);

(Continued)

(58) Field of Classification Search

None

See application file for complete search history.

(56) References Cited

U.S. PATENT DOCUMENTS

| | | |
|---|---|---|
| 3,691,016 A | 9/1972 | Patel |
| 3,773,919 A | 11/1973 | Boswell et al. |

(Continued)

FOREIGN PATENT DOCUMENTS

| | | |
|---|---|---|
| CL | 2014001254 A1 | 10/2014 |
| CL | 2014001263 A1 | 10/2014 |

(Continued)

OTHER PUBLICATIONS

Lloyd et al., Protein Engineering, Design & Selection 22:159-168 (Year: 2009).*

(Continued)

*Primary Examiner* — Phuong Huynh

(74) *Attorney, Agent, or Firm* — Sebastian Fuchs; Wyan-Ching M. Lee

(57) ABSTRACT

The present invention provides bispecific antibody constructs of a specific Fc modality characterized by comprising a first domain binding to a target cell surface antigen, a second domain binding to an extracellular epitope of the human and/or the *Macaca* CD3ε chain and a third domain, which is the specific Fc modality. Moreover, the invention provides a polynucleotide, encoding the antibody construct, a vector comprising this polynucleotide, host cells, expressing the construct and a pharmaceutical composition comprising the same.

17 Claims, 25 Drawing Sheets

Specification includes a Sequence Listing.

Related U.S. Application Data

(60) Provisional application No. 62/290,861, filed on Feb. 3, 2016.

(51) Int. Cl.
*C07K 16/28* (2006.01)
*C07K 16/46* (2006.01)

(52) U.S. Cl.
CPC ...... *C07K 16/2803* (2013.01); *C07K 16/2809* (2013.01); *C07K 16/2863* (2013.01); *C07K 16/2875* (2013.01); *C07K 16/2887* (2013.01); *C07K 16/3053* (2013.01); *C07K 16/468* (2013.01); *C07K 2317/31* (2013.01); *C07K 2317/33* (2013.01); *C07K 2317/52* (2013.01); *C07K 2317/524* (2013.01); *C07K 2317/526* (2013.01); *C07K 2317/53* (2013.01); *C07K 2317/622* (2013.01); *C07K 2317/64* (2013.01); *C07K 2317/73* (2013.01); *C07K 2317/94* (2013.01); *C07K 2319/00* (2013.01)

(56) References Cited

U.S. PATENT DOCUMENTS 3,969,287 A 7/1976 Jaworek et al.
4,179,337 A 12/1979 Davis et al.
4,195,128 A 3/1980 Gribnau et al.
4,229,537 A 10/1980 Hodgins et al.
4,247,642 A 1/1981 Hirohara et al.
4,301,144 A 11/1981 Iwashita et al.
4,330,440 A 5/1982 Ayers et al.
4,439,196 A 3/1984 Higuchi
4,447,224 A 5/1984 Decant et al.
4,447,233 A 5/1984 Mayfield
4,475,196 A 10/1984 La Zor
4,485,045 A 11/1984 Regen
4,486,194 A 12/1984 Ferrara
4,487,603 A 12/1984 Harris
4,496,689 A 1/1985 Mitra
4,544,545 A 10/1985 Ryan et al.
4,596,556 A 6/1986 Morrow et al.
4,640,835 A 2/1987 Shimizu et al.
4,670,417 A 6/1987 Iwasaki et al.
4,694,778 A 9/1987 Learn et al.
4,751,180 A 6/1988 Cousens et al.
4,790,824 A 12/1988 Morrow et al.
4,791,192 A 12/1988 Nakagawa et al.
4,816,397 A 3/1989 Boss et al.
4,816,567 A 3/1989 Cabilly et al.
4,935,233 A 6/1990 Bell et al.
4,941,880 A 7/1990 Burns
4,946,778 A 8/1990 Ladner et al.
5,013,556 A 5/1991 Woodle et al.
5,064,413 A 11/1991 McKinnon et al.
5,223,409 A 6/1993 Ladner et al.
5,225,539 A 7/1993 Winter
5,260,203 A 11/1993 Ladner et al.
5,292,658 A 3/1994 Cormier et al.
5,312,335 A 5/1994 McKinnon et al.
5,383,851 A 1/1995 McKinnon et al.
5,399,163 A 3/1995 Peterson et al.
5,418,155 A 5/1995 Cormier et al.
5,476,996 A 12/1995 Wilson et al.
5,545,806 A 8/1996 Lonberg et al.
5,545,807 A 8/1996 Surani et al.
5,565,332 A 10/1996 Hoogenboom et al.
5,569,825 A 10/1996 Lonberg et al.
5,585,089 A 12/1996 Queen et al.
5,591,669 A 1/1997 Krimpenfort et al.
5,612,205 A 3/1997 Kay et al.
5,625,126 A 4/1997 Lonberg et al.
5,625,825 A 4/1997 Rostoker et al.
5,633,425 A 5/1997 Lonberg et al.
5,643,763 A 7/1997 Dunn et al.
5,648,260 A 7/1997 Winter et al.
5,661,016 A 8/1997 Lonberg et al.
5,683,888 A 11/1997 Campbell
5,693,761 A 12/1997 Queen et al.
5,693,762 A 12/1997 Queen et al.
5,698,767 A 12/1997 Wilson et al.
5,721,367 A 2/1998 Kay et al.
5,741,668 A 4/1998 Ward et al.
5,770,429 A 6/1998 Lonberg et al.
5,777,079 A 7/1998 Tsien et al.
5,789,215 A 8/1998 Berns et al.
5,789,650 A 8/1998 Lonberg et al.
5,804,387 A 9/1998 Cormack et al.
5,814,318 A 9/1998 Lonberg et al.
5,859,205 A 1/1999 Adair et al.
5,874,299 A 2/1999 Lonberg et al.
5,874,304 A 2/1999 Zolotukhin et al.
5,876,995 A 3/1999 Bryan
5,877,397 A 3/1999 Lonberg et al.
5,925,558 A 7/1999 Tsien et al.
5,939,598 A 8/1999 Kucherlapati et al.
5,958,765 A 9/1999 Brams et al.
5,981,175 A 11/1999 Loring et al.
6,023,010 A 2/2000 Krimpenfort et al.
6,075,181 A 6/2000 Kucherlapati et al.
6,114,598 A 9/2000 Kucherlapati et al.
6,150,584 A 11/2000 Kucherlapati et al.
6,162,963 A 12/2000 Kucherlapati et al.
6,255,458 B1 7/2001 Lonberg et al.
6,300,064 B1 10/2001 Knappik et al.
6,407,213 B1 6/2002 Carter et al.
6,632,424 B1 10/2003 Lyman et al.
6,673,986 B1 1/2004 Kucherlapati et al.
7,235,641 B2 6/2007 Kufer et al.
7,575,923 B2 8/2009 Dorken et al.
7,628,986 B2 12/2009 Weber et al.
7,666,622 B2 2/2010 Sharma et al.
8,911,732 B2 12/2014 Dennis et al.
9,034,324 B2 5/2015 Kalled et al.
9,096,672 B2 8/2015 Weber et al.
9,150,664 B2 10/2015 Kufer et al.
9,243,058 B2 1/2016 Armitage et al.
9,340,621 B2 5/2016 Kufer et al.
9,567,399 B1 2/2017 Campbell et al.
9,598,500 B2 3/2017 Kufer et al.
9,617,338 B1 4/2017 Campbell et al.
9,718,893 B2 8/2017 Jung et al.
9,725,506 B2 8/2017 Dillon et al.
9,765,157 B2 9/2017 Xiao et al.
9,767,858 B2 9/2017 Bonakdar et al.
9,850,320 B2 12/2017 Bernett et al.
9,856,327 B2 1/2018 Bernett et al.
10,220,090 B2 3/2019 Armitage et al.
10,294,300 B2 5/2019 Raum et al.
10,301,391 B2 5/2019 Raum et al.
10,519,241 B2 12/2019 Raum et al.
2002/0160004 A1 10/2002 Lyman et al.
2003/0070185 A1 4/2003 Jakobovits et al.
2008/0071063 A1 3/2008 Allan et al.
2008/0260738 A1* 10/2008 Moore .................... A61P 37/00 435/69.6
2009/0304696 A1 12/2009 Lawson et al.
2010/0150918 A1* 6/2010 Kufer ..................... C07K 16/28 536/23.53
2010/0152918 A1* 6/2010 Riverin ................. F04D 27/001 700/301
2010/0267617 A1 10/2010 Baseman et al.
2011/0275787 A1* 11/2011 Kufer ................. C07K 16/2803 530/387.9
2011/0293579 A1 12/2011 Nielsen et al.
2011/0293619 A1 12/2011 Kufer et al.
2013/0129723 A1 5/2013 Blankenship et al.
2013/0129729 A1 5/2013 Kischel et al.
2013/0156769 A1 6/2013 Kufer et al.
2013/0156770 A1 6/2013 Kufer et al.
2013/0273055 A1 10/2013 Borges et al.
2013/0287774 A1* 10/2013 Zugmaier .......... C07K 16/2809 514/180
2014/0004121 A1 1/2014 Fanslow et al.

(56) References Cited

U.S. PATENT DOCUMENTS

2014/0088295 A1 3/2014 Smith et al.
2014/0128326 A1 5/2014 Cameron et al.
2014/0154253 A1 6/2014 Ng et al.
2014/0200331 A1 7/2014 Corper et al.
2014/0242079 A1 8/2014 Bacac et al.
2014/0288275 A1 9/2014 Moore et al.
2014/0302037 A1 10/2014 Borges et al.
2014/0308285 A1 10/2014 Yan et al.
2014/0348837 A1 11/2014 Kufer et al.
2015/0023967 A1 1/2015 Kufer et al.
2015/0166661 A1 6/2015 Chen et al.
2015/0368343 A1 12/2015 Xiao et al.
2015/0376287 A1 12/2015 Vu et al.
2016/0115241 A1 4/2016 Yan et al.
2016/0168263 A1 6/2016 Bigner et al.
2016/0176973 A1 6/2016 Kufer et al.
2016/0257748 A1 9/2016 Michaels et al.
2016/0340440 A1 11/2016 Fanslow et al.
2017/0029502 A1 2/2017 Raum et al.
2017/0029512 A1 2/2017 Raum et al.
2017/0037130 A1 2/2017 Raum et al.
2017/0037149 A1 2/2017 Raum et al.
2017/0121420 A1 5/2017 Heidrich et al.
2017/0129961 A1 5/2017 Raum et al.
2017/0165373 A1 6/2017 Armitage et al.
2017/0218077 A1 8/2017 Raum et al.
2017/0218078 A1 8/2017 Raum et al.
2017/0218079 A1 8/2017 Raum et al.
2017/0247476 A1 8/2017 Yan et al.
2017/0275373 A1 9/2017 Kufer et al.
2017/0349668 A1 12/2017 Rattel et al.
2017/0362321 A1 12/2017 Campbell et al.
2018/0016352 A1 1/2018 Thurecht et al.
2019/0151448 A1 5/2019 Abel et al.
2019/0263907 A1 8/2019 Raum et al.
2020/0332000 A1* 10/2020 Mcauley ................. A61P 31/12
2022/0403035 A1 12/2022 Anlahr et al.

FOREIGN PATENT DOCUMENTS

CL 2015000713 A1 7/2015
CL 2015001988 A1 11/2015
CL 2015002071 A1 11/2015
CL 2016000363 A1 10/2016
CL 2016001556 A1 2/2017
CL 2015002742 A1 3/2017
CL 2016000564 A1 3/2017
CL 2017000278 A1 11/2017
CL 2017001090 A1 1/2018
CL 2017001361 A1 2/2018
CL 2017001328 A1 3/2018
CL 2017001866 A1 4/2018
CL 2017002641 A1 4/2018
CL 2016002460 A1 5/2018
CL 2018000263 A1 10/2018
CL 2018000267 A1 10/2018
CL 2018000268 A1 10/2018
CL 2018000269 A1 10/2018
CL 2018000270 A1 10/2018
CL 2018001175 A1 10/2018
CL 2018000431 A1 11/2018
CL 2018002063 A1 11/2018
CL 2018002057 A1 2/2019
CL 2019000146 A1 4/2019
CL 2019000726 A1 5/2019
CL 2019000738 A1 5/2019
CL 2019000119 A1 6/2019
CL 2019001198 A1 7/2019
CN 101495510 A 7/2009
CN 104829726 A 8/2015
CN 104829728 A 8/2015
EP 0036676 A1 9/1981
EP 0058481 A1 8/1982
EP 0088046 A2 9/1983
EP 0133988 A2 3/1985
EP 0143949 A1 6/1985
EP 0171496 A2 2/1986
EP 0173494 A2 3/1986
EP 0183070 A2 6/1986
EP 0239400 A2 9/1987
EP 0244234 A2 11/1987
EP 0402226 A1 12/1990
EP 0463151 A1 1/1992
EP 0546073 A1 6/1993
EP 0773288 A2 5/1997
EP 0843961 A1 5/1998
EP 2647707 A1 10/2013
EP 2840091 A1 2/2015
GB 2177096 A 1/1987
JP 3068180 B2 7/2000
JP 3068506 B2 7/2000
JP 3068507 B2 7/2000
JP 2015-504306 A 2/2015
WO 87/05330 A1 9/1987
WO 88/01649 A1 3/1988
WO 88/09344 A1 12/1988
WO 91/10741 A1 7/1991
WO 92/03918 A1 3/1992
WO 92/15673 A1 9/1992
WO 92/22645 A1 12/1992
WO 92/22647 A1 12/1992
WO 92/22670 A1 12/1992
WO 93/12227 A1 6/1993
WO 93/15722 A1 8/1993
WO 94/00569 A1 1/1994
WO 94/02602 A1 2/1994
WO 94/10308 A1 5/1994
WO 94/25585 A1 11/1994
WO 95/07463 A1 3/1995
WO 96/14436 A1 5/1996
WO 96/33735 A1 10/1996
WO 96/34096 A1 10/1996
WO 97/13852 A1 4/1997
WO 97/38731 A1 10/1997
WO 98/14605 A1 4/1998
WO 98/24884 A1 6/1998
WO 98/24893 A2 6/1998
WO 98/26277 A2 6/1998
WO 98/52976 A1 11/1998
WO 99/49019 A2 9/1999
WO 99/54440 A1 10/1999
WO 00/06605 A2 2/2000
WO 00/34317 A2 6/2000
WO 00/76310 A1 12/2000
WO 03/47336 A2 6/2003
WO 2005/010151 A2 2/2005
WO 2005/040220 A1 5/2005
WO 2005/077981 A2 8/2005
WO 2006/138181 A2 12/2006
WO 2007/042261 A2 4/2007
WO 2007/098420 A2 8/2007
WO 2008/012543 A1 1/2008
WO 2008/119567 A2 10/2008
WO 2008/119657 A1 10/2008
WO 2008/131242 A1 10/2008
WO 2008/143954 A2 11/2008
WO 2009/127691 A1 10/2009
WO 2009/132058 A2 10/2009
WO 2010/037836 A2 4/2010
WO 2010/037838 A2 4/2010
WO 2010/045261 A1 4/2010
WO 2010/124797 A1 11/2010
WO 2011/051489 A2 5/2011
WO 2011/076922 A1 6/2011
WO 2011/121110 A1 10/2011
WO 2012/059486 A1 5/2012
WO 2012/088461 A2 6/2012
WO 2012/150319 A1 11/2012
WO 2013/026833 A1 2/2013
WO 2013/026837 A1 2/2013
WO 2013/072406 A1 5/2013
WO 2013/072415 A1 5/2013
WO 2013/075048 A1 5/2013
WO 2013/075066 A2 5/2013

(56) References Cited

FOREIGN PATENT DOCUMENTS

| | | | | | |
|---|---|---|---|---|---|
| WO | 2013/092001 | A1 | | 6/2013 | |
| WO | 2013/126746 | A2 | | 8/2013 | |
| WO | 2013/128027 | A1 | | 9/2013 | |
| WO | 2013/135896 | A1 | | 9/2013 | |
| WO | 2013/185010 | A1 | | 12/2013 | |
| WO | 2014/004549 | A2 | | 1/2014 | |
| WO | 2014/031476 | A1 | | 2/2014 | |
| WO | 2014/047231 | A1 | | 3/2014 | |
| WO | 2014/072481 | A1 | | 5/2014 | |
| WO | 2014/100490 | A1 | | 6/2014 | |
| WO | 2014/114800 | A1 | | 7/2014 | |
| WO | 2014/122143 | A1 | | 8/2014 | |
| WO | 2014/125273 | A1 | | 8/2014 | |
| WO | 2014/131712 | A1 | | 9/2014 | |
| WO | 2014/138449 | A1 | | 9/2014 | |
| WO | 2014/140248 | A1 | | 9/2014 | |
| WO | 2014/140358 | A1 | | 9/2014 | |
| WO | 2014/144722 | A2 | | 9/2014 | |
| WO | 2014/151910 | A1 | | 9/2014 | |
| WO | WO-2014153063 | A1 | * | 9/2014 | ............. A61P 29/00 |
| WO | 2015/006482 | A1 | | 1/2015 | |
| WO | 2015/018527 | A1 | | 2/2015 | |
| WO | 2015/026894 | A2 | | 2/2015 | |
| WO | 2015/036583 | A2 | | 3/2015 | |
| WO | 2015/048272 | A1 | | 4/2015 | |
| WO | 2015/063187 | A1 | | 5/2015 | |
| WO | 2015/095392 | A1 | | 6/2015 | |
| WO | 2015/107015 | A1 | | 7/2015 | |
| WO | 2015/149077 | A1 | | 10/2015 | |
| WO | 2015/181805 | A1 | | 12/2015 | |
| WO | 2016/016859 | A1 | | 2/2016 | |
| WO | 2016/020309 | A1 | | 2/2016 | |
| WO | 2016/071355 | A1 | | 5/2016 | |
| WO | 2016/086189 | A2 | | 6/2016 | |
| WO | 2016/086196 | A2 | | 6/2016 | |
| WO | 2016/116626 | A1 | | 7/2016 | |
| WO | 2016/166360 | A1 | | 10/2016 | |
| WO | 2017/021349 | A1 | | 2/2017 | |
| WO | 2017/021354 | A1 | | 2/2017 | |
| WO | 2017/021356 | A1 | | 2/2017 | |
| WO | 2017/021362 | A1 | | 2/2017 | |
| WO | 2017/031104 | A1 | | 2/2017 | |
| WO | 2017/079121 | A2 | | 5/2017 | |
| WO | 2017/134134 | A1 | | 8/2017 | |
| WO | 2017/134140 | A1 | | 8/2017 | |
| WO | 2017/134158 | A1 | | 8/2017 | |
| WO | 2018/015340 | A1 | | 1/2018 | |
| WO | 2018/017786 | A2 | | 1/2018 | |
| WO | 2018/058001 | A1 | | 3/2018 | |
| WO | 2018/067331 | A1 | | 4/2018 | |
| WO | 2018/083204 | A1 | | 5/2018 | |

OTHER PUBLICATIONS

Edwards et al., J Mol Biol. 334(1): 103-118 (Year: 2003).*

Shepard et al., PLOS One 18(6): e0273884 (Year: 2023).*

Kelly et al., Mesothelin-targeted agents in clinical trials and in preclinical development, Mol. Cancer Ther., 11:517-25 (2012).

Kendrick et al., Physical stabilization of proteins in aqueous solution, in: Rational design of stable protein formulations: theory and practice, Carpenter and Manning (eds.), Pharmaceutical Biotechnology, 13:61-84 (2002).

Kipriyanov et al., Bispecific tandem diabody for tumor therapy with improved antigen binding and pharmacokinetics, J. Mol. Biol., 293:41-56 (1999).

Knappe et al., Herpesvirus saimiri-transformed macaque T cells are tolerated and do not cause lymphoma after autoloaous reinfusion, Blood, 95(10):3256-3261 (2000).

Kobayashi et al., Tryptophan H33 plays an important role in pyrimidine (6-4) pyrimidone photoproduct binding by a high-affinity antibody, Protein Eng., 12:879-884 (1999).

Kohler et al., Continuous cultures of fused cells secreting antibody of predefined specificity. Nature. 256:495-7 (1975).

Kontermann et al., Bispecific antibodies, Drug Discovery Today. 20:838-47 (2015).

Kontermann, Dual targeting strategies with bispecific antibodies, mAbs. 4(2):182-197 (2012).

Kontermann., Recombinant bispecific antibodies for cancer therapy. Acta Pharmacologica Sinica, 26(1): 1-9 (2005).

Kozbor et al., The production of monoclonal antibodies from human lymphocytes. Immunol. Today. 4(3): 72-9 (1983).

Krupka et al., CD33 target validation and sustained depletion of AML blasts in long-term cultures by the bispecific T-cell-engaging antibody AMG 330, Blood, 123:356-365 (2014).

Kufer et al., A revival of bispecific antibodies. Trends Biotechnol. 22(5): 238-44 (2004).

Kufer et al., Construction and biological activity of a recombinant bispecific single-chain antibody designed for therapy of minimal residual colorectal cancer. Cancer Immunol. Immunother. 45: 193-7 (1997).

Kumar et al., Molecular cloning and expression of the Fabs of human autoantibodies in *Escherichia coli*, Determination of the heavy or light chain contribution to the anti-DNA/-cardiolipin activity of the Fab, J. Biol. Chem., 275:35129-35136 (2000).

Kuo et al., Engineering a CD123xCD3 bispecific scFv immunofusion for the treatment of leukemia and elimination of leukemia stem cells, Protein Eng. Des. Sel., 25(10):561-570 (2012).

Landschulz et al., The leucine zipper: a hypothetical structure common to a new class of DNA binding proteins, Science, 240:1759-1764 (1988).

Langer et al., Biocompatibility of polymeric delivery systems for macromolecules. J. Biomed. Mater. Res. 15(2): 267-77 (1981).

Langer, Controlled release of macromolecules, Chem. Tech., 12:98-105 (1982).

Lippincott-Schwartz, Antibodies as call biological tools, Current Protocols in Cell Biology, 16.0.1-16.0.2 (2002).

Liu et al., Monoclonal antibodies to the extracellular domain of prostate-specific membrane antigen also react with tumor vascular endothelium, Cancer Res., 57:3629-3634 (1997).

Loffler et al., A recombinant bispecific single-chain antibody, CD19 x CD3, induces rapid and high lymphoma-directed cytotoxicity by unstimulated T lymphocytes. Blood. 95: 2098-103 (2000).

Lopes et al., Immunohistochemical and pharmacokinetic characterization of the site-specific immunoconjugate CYT-356 derived from antiprostate monoclonal antibody 7E11-C5, Cancer Res., 50:6423-6429 (1990).

Lowman et al., Selecting high-affinity binding proteins by monovalent phage display. Biochemistry. 30: 10832-7 (1991).

Lu et al., Tetravalent anti-CD20/CD3 bispecific antibody for the treatment of B cell lymphoma, Biochem. Biophys. Res. Commun., 473:808-813 (2016).

Lutterbuese et al., T cell-engaging BiTE antibodies specific for EGFR potently eliminate KRAS-and BRAF-mutated colorectal cancer cells, Proc. Natl. Acad. Sci. USA, 107:12605-12610 (2010).

MacCallum et al., Antibody-antigen interactions: Contact analysis and binding site topography. J. Mol. Biol. 262:732-45 (1996).

Mack et al., A small bispecific antibody construct expressed as a functional single-chain molecule with hiah tumor cell cytotoxicity. Proc. Natl. Acad. Sci. USA 92(15): 7021-5 (1995).

Mack et al., Biologic properties of a bispecific single-chain antibody directed against 17-1A (EpCAM) and CD3: tumor cell-dependent T cell stimulation and cytotoxic activity. J. Immunol. 158: 3965-70 (1997).

Malmborg et al., BIAcore as a tool in antibody engineering, J. Immunol. Meth., 183:7-13 (1995).

Marks et al., By-passing immunization. Human antibodies from V-gene libraries displayed on phage. J. Mol. Biol. 222:581-97 (1991).

Martin et al., Irreversible coupling of immunoglobulin fragments to preformed vesicles. An improved method for liposome targeting. J. Biol. Chem. 257:286-8 (1982).

Martin et al., Structural families in loops of homologous proteins: automatic classification, modelling and application to antibodies. J. Mol. Biol. 263: 800-15 (1996).

Mather et al., Culture of testicular cells in hormone-supplemented serum-free medium, Ann. N.Y. Acad. Sci., 383:44-68 (1982).

(56) References Cited

OTHER PUBLICATIONS

Mather, Establishment and characterization of two distinct mouse testicular epithelial cell lines. Biol. Reprod. 23: 243-51 (1980).
Matthias et al., Regression of human prostate cancer xenografts in mice by AMG 212/BAY2010112, a novel PSMA/CD3-Bispecific BiTE antibody cross-reactive with non-human primate antigens. Molecular Cancer Therapeutics 11(12): 2664-2673 (2002).
Mendez et al., Functional transplant of megabase human immunoglobulin loci recapitulates human antibody response in mice. Nature Genetics 15:146-56 (1997).
Morrison et al., Chimeric human antibody molecules: mouse antigen-binding domains with human constant reaion domains. Proc. Natl. Acad. Sci. USA 81: 6851-5 (1984).
Morrison et al., Combinatorial alanine-scanning. Curr. Opin. Chem. Biol. 5(3): 302-7 (2001).
Morrison, Transfectomas provide novel chimeric antibodies. Science 229(4719): 1202-7 (1985).
Moscatello et al., Frequent expression of a mutant epidermal growth factor receptor in multiple human tumors, Cancer Res., 55(23):5536-5539 (1995).
Murphy et al., Evaluation and comparison of two new prostate carcinoma markers, Free-prostate specific antigen and prostate specific membrane antigen, Cancer, 78:809-818 (1996).
NCBI Accession No. AJN78919.1, Anti-mesothelin antibodies and immunoconjugates, dated Feb. 14, 2015.
Needleman et al., A general method applicable to the search for similarities in the amino acid sequence of two proteins. J. Mol. Biol. 48: 443-53 (1970).
Ngo et al., Computational complexity, protein structure prediction, and the Levinthal paradox, The Protein Folding Problem and Tertiary Structure Prediction, 492-495 (1994).
Nolan et al., Fluorescence-activated cell analysis and sorting of viable mammalian cells based on beta-D-galactosidase activity after transduction of *Escherichia coli* lacZ. Proc. Natl. Acad. Sci. USA. 85: 2603-7 (1988).
Novak et al., Expression of BCMA, TACI, and BAFF-R in multiple myeloma: a mechanism for growth and survival, Blood, 103:689-694 (2004).
O'Keefe et al., Mapping, genomic organization and promoter analysis of the human prostate-specific membrane antigen gene, Biochem. Biophys. Acta., 1443:113-127 (1998).
Olapade-Olaopa et al., Evidence for the differential expression of a variant EGF receptor protein in human prostate cancer, Br. J. Cancer, 82(1):186-194 (2000).
Olsson et al., Human-human monoclonal antibody-producing hybridomas: Technical aspects, Meth. Enzymol., 92:3-16 (1982).
Fanslow et al., Structural characteristics of CD40 ligand that determine biological function, Semin. Immunol., 6:267-278(1994).
Fecker et al., Expression of single-chain antibody fragments (scFv) specific for beet necrotic yellow vein virus coat protein or 25 kDa protein in *Escherichia coli* and Nicotiana benthamiana. Plant Mol. Biol. 32: 979-86 (1996).
Feng et al., Progressive sequence alignment as a prerequisite to correct phylogenetic trees. J. Mol. Evol. 35: 351-60 (1987).
Feulner et al., A novel CD33/CD3-bispecific BiTE antibody can effectively recruit autologous T cells from AML-patients for in vitro cell lysis of CD33+ blasts, Proceedings of the 103rd Annual Meeting of the American Association for Cancer Research, Chicago, IL (Abstract) (2012).
Fujimori et al., A modeling analysis of monoclonal antibody percolation through tumors: A binding-site barrier, J. Nuc. Med., 31: 1191-1198 (1990).
Gabizon et al., Pharmacokinetics and tissue distribution of doxorubicin encapsulated in stable liposomes with long circulation times. J. National Cancer Inst. 81(19): 1484-8 (1989).
Garcia De Palazzo et al., Expression of mutated epidermal growth factor receptor by non-small cell luna carcinomas, Cancer Res., 53(14):3217-3220 (1993).
Ge et al., Evidence of high incidence of EGFRvIII expression and coexpression with EGFR in human invasive breast cancer by laser capture microdissection and immunohistochemical analysis, Int. J. Cancer, 98(3):357-3561 (2002).
Graham et al., Characteristics of a human cell line transformed by DNA from human adenovirus type 5, J. Gen. Virol., 36:59-74 (1977).
Green et al., Antigen-specific human monoclonal antibodies from mice engineered with human Ig heavy and light chain YACs. Nat. Genet. 7: 13-21 (1994).
Green et al., Regulation of B cell development by variable gene complexity in mice reconstituted with human immunoglobulin yeast artificial chromosomes. J. Exp. Med. 188: 483-95 (1998).
Gussow et al., Humanization of monoclonal antibodies, Methods in Enzymology, 203: 99-121 (1991).
Hakimuddin et al., A chemical method for the deglycosylation of proteins. Arch. Biochem. Biophys. 259: 52-7 (1987).
Hawkins et al., Selection of phaae antibodies by bindina affinity. J. Mol. Biol. 254: 889-96 (1992).
Hay et al., Clinical development success rates for investigational drugs, Nat. Biotechnol., 32(1 ):40-51 (2014).
Heim et al., Engineering green fluorescent protein for improved brightness, longer wavelengths and fluorescence resonance energy transfer. Curr. Biol. 6: 178-82 (1996).
Helwick et al., Bispecific antibodies: successes and challenges, The ASCO Post, HSP News Service, 2020.
Hiatt et al., Production of antibodies in transgenic plants. Nature 342: 76-8 (1989).
Higgins et al., Fast and sensitive multiple sequence alignments on a microcomputer. CABIOS 5: 151-3 (1989).
Hipp et al., BI 836909, a novel bispecific T Cell engager for the treatment of multiple myeloma induces highly specific and efficacious lysis of multiple mieloma cells in Vitro and shows anti-tumor activity in Vivo, Blood, 126(23):2999 (2015).
Hoffmann et al., Generation, selection and preclinical characterization of an Fe-optimized FLT3 antibody for the treatment of myeloid leukemia, Leukemia, 26:1228-1237 (2012).
Holliger et al., "Diabodies": small bivalent and bispecific antibody fragments. Proc. Natl. Acad. Sci. USA 90(14): 6444-8 (1993).
Holt et al., Domain antibodies: Proteins for therapy, Trends in Biotechnol., 21 (11 ):484-490 (2003).
Hoppe et al., A parallel three stranded alpha-helical bundle at the nucleation site of collagen triple-helix formation, FEBS Lett., 344:191-195 (1994).
Horoszewicz et al., Monoclonal antibodies to a new antigenic marker in epithelial prostatic cells and serum of prostatic cancer patients, Anticancer Res., 7:927-935 (1987).
Hubert et al., STEAP: a prostate-specific cell-surface antigen highly expressed in human prostate tumors, Pros. Natl. Acad. Sci. USA, 96:14523-14528 (1999).
Huehls et al., Bispecific T-cell engagers for cancer immunotherapy, Immunol. Cell. Biol., 93(3):290-296 (2015).
Huston et al., Protein engineering of antibody binding sites: recovery of specific activity in an anti-digoxin single-chain Fv analogue produced in *Escherichia coli*. Proc. Natl. Acad. Sci. USA. 85: 5879-83 (1988).
Hwang et al., Hepatic uptake and degradation of unilamellar sphingomyelin/cholesterol liposomes: A kinetic study. Proc. Natl. Acad. Sci. USA. 77: 4030-4 (1980).
Hwang et al., Use of human germline genes in a CDR homology-based approach to antibody humanization, Methods 36(1):35-42 (2005).
Ichiki et al., Regulation of the expression of human C epsilon germline transcript, Identification of a novel IL-4 responsive element, J. Immunol., 150:5408-5417 (1993).
IMGT Scientific chart (Year: 2016).
International Application No. PCT/EP2017/052239, International Preliminary Report on Patentability, mailed Aug. 16, 2018.
International Application No. PCT/EP2017/052239, International Search Report and Written Opinion, mailed May 11, 2017.
International Search Report and Written Opinion corresponding to International Application No. PCT/EP2016/068304, mailed Nov. 29, 2016.

(56) References Cited

OTHER PUBLICATIONS

International Search Report and Written Opinion corresponding to International Application No. PCT/EP2016/068319, mailed Nov. 23, 2016.
International Search Report and Written Opinion corresponding to International Application No. PCT/EP2016/068332, mailed Nov. 28, 2016.
International Search Report and Written Opinion corresponding to International Application No. PCT/EP2017/052212, mailed Jul. 4, 2017.
Israeli et al., Expression of the prostate-specific membrane antigen, Cancer Res., 54:1807-1811 (1994).
Israeli et al., Molecular cloning of a complementary DNA encoding a prostate-specific membrane antigen, Cancer Res., 53:227-230 (1993).
Jones et al., Replacing the complementarity-determine regions in a human antibody with those from a mouse. Nature, 321: 522-5 (1986).
Jubala et al., CD20 expression in normal canine B cells and in canine non hodgkin-lymphoma, Vet. Pathol., 42:468-476 (2005).
Karlin et al., Applications and statistics for multiple high-scoring segments in molecular sequences. Proc. Natl. Acad. Sci. USA 90: 5873-7 (1993).
Kaufman, Selection and coamplification of heterologous genes in mammalian cells, Meth. Enzvmol., 185:537-566 (1990).
Kawakami et al., Enhanced expression of prostate-specific membrane antigen gene in prostate cancer as revealed by in situ hybridization, Cancer Res., 57:2321-2324 (1997).
Cazorla F.J., et al., "QoS for High-Performance SMT Processors in Embedded Systems," IEEE Micro, vol. 24 (4), Jul.-Aug. 2004, pp. 24-31.
Altschul et al., Basic local alignment search tool. J. Mol. Biol. 215:403-10 (1990).
Altschul et al., Gapped BLAST and PSI-BLAST: a new generation of protein database search programs. Nucl. Acids Res. 25(17): 3389-402 (1997).
Altschul et al., Local alignment statistics. Methods in Enzymology, 266:460-80 (1996).
Andersen et al., Extending serum half-life of albumin by engineering FcRn binding, J. Biol. Chem., 289(19):13492-13502 (2014).
Aplin et al., Preparation, properties, and applications of carbohydrate conjugates of proteins and lipids, CRC Crit. Rev. Biochem., 259-306 (1981).
Arakawa et al., Solvent interactions in pharmaceutical formulations. Pharm Res. 8(3): 285-91 (1991).
Artsaenko et al., The expression of a single-chain Fv antibody against abscisic acid creates a wilty phenotype in transaenic tobacco. The Plant J. 8: 745-50 (1995).
Bacac et al., A novel carcinoembryonic antigen T-Cell bispecific antibody (CEA TCB) for the treatment of solid tumors, Clin. Cancer Res., 22(13):3286-3297 (2016).
Beatty et al., Mesothelin-specific chimeric antigen receptor mRNA-engineered T cells induce anti-tumor activity in solid malignancies, Cancer Immunol Res., 2(2): 112-120 (2014).
Beckman et al., Antibody constructs in cancer therapy: protein engineering strategies to improve exposure in solid tumors, Cancer, 109(2):170-179 (2007).
Bellucci et al., Graft-versus-tumor response in patients with multiple myeloma is associated with antibody response to BCMA, a plasma-cell membrane receptor, Blood, 105(10):3945-3950 (2005).
Bird et al., Sinale-chain antigen-binding proteins, Science, 242:423-426 (1988).
Bork et al. Go hunting in sequence databases but watch out for the traps, Trends in Genetics, 12(10): 425-427 (1996).
Bork, Powers and pitfalls in sequence analysis: the 70% hurdle, Genome. Res., 10:398-400 (2000).
Brenner, Errors in genome annotation, Trends Genet., 15(4):132-133 (1999).
Brinkman et al., The making of bispecific antibodies, mAbs, 9(2):182-212 (2017).
Bruhl et al., Depletion of CCR5-expressing cells with bispecific antibodies and chemokine toxins: a new strategy in the treatment of chronic inflammatory diseases and HIV. Immunol. 166: 2420-6 (2001).
Brummell et al., Probing the combining site of an anti-carbohydrate antibody by saturation-mutagenesis: role of the heavy-chain CDR3 residues, Biochemistry, 32:1180-1187 (1993).
Burger et al., Expression analysis of delta-catenin and prostate-specific membrane antigen: their potential as diagnostic markers for prostate cancer, Int. J. Cancer, 100:228-237 (2002).
Burks et al., In vitro scanning saturation mutagenesis of an antibody binding pocket, Proc. Natl. Acad. Sci., 94:412-417 (1997).
Carpenter et al., B-cell maturation antigen is a promising target for adoptive T-cell therapy of multiple myeloma, Clin. Cancer Res., 19(8):2048-2060 (2013).
Carter et al., High level *Escherichia coli* expression and production of a bivalent humanized antibody fragment. Biotechnology 10: 163-7 (1992).
Casset et al., A peptide mimetic of an anti-CD4 monoclonal antibody by rational design, Biochemical and Biophysical Research Communications, 307: 198-205 (2003).
Chalfie et al., Green fluorescent protein as a marker for gene expression. Science. 263: 802-5 (1994).
Chang et al., Comparison of anti-prostate-specific membrane antigen antibodies and other immunomarkers in metastatic prostate carcinoma, Urology, 57:1179-1183 (2001).
Chang et al., Five different anti-prostate-specific membrane antigen (PSMA) antibodies confirm PSMA expression in tumor-associated neovasculature, Cancer Res., 59:3192-3198 (1999).
Chang et al., Molecular cloning of mesothelin, a differentiation antigen present on mesothelium, mesotheliomas, and ovarian cancers, Proc. Natl. Acad. Sci. USA, 93(1):136-140 (1996).
Cheadle et al., Cloning and expression of the variable regions of mouse myeloma protein MOPC315 in *E. coli*: recovery of active FV fragments, Mol. Immunol., 29:21-30 (1992).
Cheng et al., Structural design of disialoganglioside GD2 and CD3-bispecific antibodies to redirect T cells for tumor therapy, Int. J. Cancer, 136(2):476-486 (2015).
Cheson et al., Report of an international workshop to standardize response criteria for Non-Hodgkin's Lymphomas. J. Clin. Oncol. 17(4): 1244-53 (1999).
Choi et al., Systemic administration of a bispecific antibody targeting EGFRviii successfully treats intracerebral glioma, Proc. Natl. Acad. Sci. USA, 110(1):270-275 (2013).
Chothia et al., Canonical structures for the hypervariable regions of immunoglobulins. J. Mol. Biol. 196: 901-17 (1987).
Chothia et al., Conformation of immunoglobulin hypervariable regions. Nature 342: 877-83 (1989).
Chu et al., Immunotherapy with Long-Lived Anti-CD123 x Anti-CD3 Bispecific Antibodies Stimulates Potent T Cell-Mediated Killing of Human AML Cell Lines and CD123+ Cells in Monkeys: A Potential Therapy for Acute Myelogenous Leukemia. 616. Acute Myeloid Leukemia: Novel Therapy, excluding Transplantation: Poster II, Blood, 124(21):2316 (2014).
Chu et al., Immunotherapy with long-lived anti-CD20 x Anti-CD3 bispecific antibodies stimulates potent T Cell-mediated killing of human B cell lines and of circulating and lymphoid B Cells lymphomas and leukemias, Blood, (2014).
Clackson et al., Making antibody fragments using phage display libraries. Lett. Nature 352: 624-8 (1991).
Colman, Effects of amino acid sequence changes on antibody-antigen interactions, Res. Immunol., 145:33-36 (1994).
Cook et al., The human immunoglobulin VH repertoire. Immunol. Today 16(5): 237-42 (1995).
Coquery et al., Regulatory roles the tumor necrosis factor receptor BCMA, Crit. Rev. Immunol., 32(4):287-305 (2010).
Cunningham et al., High-resolution epitope mapping of hGH-receptor interactions by alanine-scanning mutagenesis, Science, 244:1081-1085 (1989).
Dall'Acqua et al., Contribution of domain interface residues to the stability of antibody CH3 domain homodimers. Biochemistry. 37: 9266-73 (1998).

(56) References Cited

OTHER PUBLICATIONS

Devereux et al., A comprehensive set of sequence analysis programs for the VAX, Nucl. Acid. Res., 12:387-395 (1984).
Doerks et al., Protein annotation: detective work for function prediction, Trends in Genetics, 14(6):248-250 (1998).
Durben et al., Characterization of a Bispecific FLT3 X CD3 Antibody in an Improved, Recombinant Format for the Treatment of Leukemia, Mol. Ther., 23:648-655 (2015).
Duskin et al., Relationship of the structure and biological activity of the natural homologues of tunicamycin. J. Biol. Chem. 257(6): 3105-9 (1982).
Edge et al., Deglycosylation of glycoproteins by trifluoromethanesulfonic acid. Anal. Biochem. 118: 131-7 (1981).
Emlet et al., Targeting a glioblastoma cancer stem-cell population defined by EGF receptor variant III, Cancer Res., 74(4):1238-1249 (2014).
Eppstein et al., Biological activity of liposome-encapsulated murine interferon y is mediated by a cell membrane receptor. Proc. Natl. Acad. Sci. USA 82: 3688-92 (1985).
Fortmuller et al., Effective targeting of prostate cancer by lymphocytes redirected by a PSMA?x?CD3 bispecific single-chain diabody, Prostate., 71(6):588-596 (2011).
Friedrich et al., Regression of human prostate cancer xenografts in mice by AMG 212/BAY2010112, a novel PSMA/CD3-Bispecific BiTE antibody cross-reactive with non-human primate antigens, Mol. Cancer Ther., 11(12):2664-2673 (2012).
Ha et al., Immunoglobulin Fc heterodimer platform technology: From design to applications in therapeutic antibodies and proteins, Front. Immunol., 7(394):1-16 (2016).
Huntington et al., A BAFF antagonist suppresses experimental autoimmune encephalomyelitis by targeting cell-mediated and humoral immune responses, Int. Immunol., 18(10):1473-1485 (2006).
Jang et al., The structural basis for DNA binding by an anti-DNA autoantibody, Mol. Immunol., 35:1207-1217 (1998).
Moisini et al., BAFF: a local and system target in autoimmune disease, Clin. Exp. Immunol., 158:155-163 (2009).
Owen et al., Synthesis of a functional anti-phytochrome single-chain Fv protein in transgenic tobacco. Bio/Technology. 10: 790-4 (1992).
Padlan, Anatomy of the antibody molecule, Malec. Immunol., 31(3):169-217 (1993).
Paul, William E., Fundamental Immunology, 3rd Edition, Raven Press, New York, Chapt. 8, 292-295.
Pearson et al., Improved tools for biological sequence comparison. Proc. Natl. Acad. Sci. USA. 85:2444-8 (1988).
Pelletier et al., Comparison of soluble decoy IgG fusion proteins of BAFF-R and BCMA as antagonists for BAFF, J. Biol. Chem., 278(35):33127-33133 (2003).
Presta, Antibody enaineerina. Curr. Op. Struct. Biol. 2: 593-6 (1992).
Raag et al., Single-chain Fvs, FASEB J., 9(1):73-80 (1995).
Randolph et al., Surfactant-protein interactions. Pharm Biotechnol. 13: 159-75 (2002).
Raum et al., Anti-self antibodies selected from a human IgD heavy chain repertoire: a novel approach to generate therapeutic human antibodies against tumor-associated differentiation antigens, Cancer Immunol. Immunother., 50:141-150 (2001).
Reiter et al., Prostate stem cell antigen: a cell surface marker overexpressed in prostate cancer, Proc. Nat. Acad. Sci. USA, 95:1735-1740 (1998).
Rennert et al., A soluble form of B Cell maturation factor antigen, a receptor for the tumor necrosis factor family member APRIL, inhibits tumor cell growth., J. Exp. Med., 192(11):1677-1683 (2000).
Riechmann et al., Reshaping human antibodies for therapy. Nature 332: 323-9 (1988).
Ross et al., Correlation of primary tumor prostate-specific membrane antigen expression with disease recurrence in prostate cancer, Clin. Cancer Res., 9:6357-6362 (2003).
Rouet et al., Fully human VH single domains that rival the stabilitty and cleft recognition of camelid antibodies, J. Biol. Chem., 290:11905-11917 (2015).
Rudikoff et al., Single amino acid substitution altering antigen-binding specificity, Proc. Natl. Acad. Sci. USA, 79(6):1979-1983 (1982).
Rudnick et al., Affinity and avidity in antibody-based tumor targeting, Cancer Biother. Radiopharm., 24:155-162 (2009).
Ryan et al., Antibody targeting of B-cell maturation factor antigen on malignant plasma cells, Mol. Cancer Ther., 6(11):3009-3018 (2007).
Schatz et al., Abstract 2726: Efficacy and candidate biomarker evaluation for the anti-mesothelin antibody drug conjugate (ADC) BAY 94-9343, mesothelin-ADC in mesothelin-positive preclinical xenoaraft models, Cancer Research 72(8 Surmlement):2726-2726 (2012).
Schier et al., Efficient in vitro affinity maturation of phage antibodies using BIAcore guided selections. Hum. Antibodies Hybridomas. 7(3): 97-105 (1996).
Schlereth et al., T-cell activation and B-cell depletion in chimpanzees treated with a bispecific anti-CD19/anti-CD3 single-chain antibody construct. Cancer Immunol. Immunother. 55: 503-14 (2006).
Schliemann et al., An essential role for BAFF in the normal development of B cells through a BCMA-independent pathway, Science, 293(5537):2111-2114 (2001).
Sewell et al., 319 Ant-PSMA X Anti-CD3 Bispecific Antibody Efficiently Redirects T Cell Cytotoxicity in Castrate-resistant prostate cancer models, European Journal of Cancer, Elsevier, Amsterdam, NL, 48(6):98 (2012).
Sidman et al., Controlled release of macromolecules and pharmaceuticals from synthetic polypeptides based on glutamic acid. Biopolymers 2: 547-56 (1983).
Skerra et al., Assembly of a functional immunoglobulin Fv fragment in *Escherichia coli*, Science, 242:1038-1041 (1988).
Skolnick et al., From genes to protein structure and function: novel applications of computational approaches in the genomic era, Trends in Biotech., 18(1):34-39 (2000).
Smith et al., Comparison of biosequences. Adv. Appl. Math. 2: 482-9 (1981).
Smith et al., The challenges of genome sequence annotation or "The devil is in the details", Nat. Biotech., 15:1222-1223 (1997).
Smith, Filamentous fusion phage: Novel expression vectors that display cloned antigens on the virion surface. Science. 228: 1315-7 (1985).
Smith-Gill et al., Contributions of immunoglobulin heavy and light chains to antibody specificity for lysozyme and two haptens, J. Immunol., 139:4135-4144 (1987).
Sokoloff et al., A dual-monoclonal sandwich assay for prostate-specific membrane antigen: levels in tissues, seminal fluid and urine, Prostate, 43:150-157 (2000).
Song et al. Light chain of natural antibody plays a dominant role in protein antigen binding, Biochem. Biophys. Res. Comm., 268: 390-394 (2000).
Songsivilai et al., Bispecific antibody: a tool for diagnosis and treatment of disease. Clin. Exp. Immunol. 79: 315-21 (1990).
Stauber et al., Development and applications of enhanced areen fluorescent protein mutants. Biotechniques 24: 462-71 (1998).
Sun et al., Anti-CD20/CD3 T cell-dependent bispecific antibody for the treatment of B cell malignancies, Sci. Transl. Med., 7:287ra70 (2015).
Sutherland et al., Targeting BAFF: immunomodulation for autoimmune diseases and lymphomas, Pharmacol. Ther., 112:774-786 (2006).
Sweat et al., Prostate-specific membrane antigen expression is greatest in prostate adenocarcinoma and lymph node metastases, Urology 52:637-640 (1998).
Tai et al., Targeting B-cell maturation factor antigen in multiple myeloma, Immunother., 7(11):1187-1199 (2015).
Takeda et al., Construction of chimaeric processed immunoglobulin genes containing mouse variable and human constant region sequences. Nature, 314: 452-4 (1985).

(56) References Cited

OTHER PUBLICATIONS

Teng et al., Construction and testing of mouse—human heteromyelomas for human monoclonal antibody production. Proc. Natl. Acad. Sci. USA, 80: 7308-12 (1983).
Thotakura et al., Enzymatic deglycosylation of glycoproteins. Meth. Enzymol. 138: 350-9 (1987).
Thurber et al., Antibody tumor penetration: transport opposed by systemic and antigen-mediated clearance, Adv. Drug Deliv. Rev., 60: 1421-1434 (2008).
Tokuriki et al., Stability effects of mutations and protein evolvability, Curr. Opin. Structural. Biol., 19:596-604 (2009).
Tomlinson et al., The repertoire of human germline VH sequences reveals about fifty groups of VH seaments with different hypervariable loops. J. Mol. Biol. 227: 776-98 (1992).
Tomlinson et al., The structural repertoire of the human V kappa domain. EMBO J. 14: 4628-38 (1995).
Topp et al., Anti-CD19 BITE Blinatumomab induces high complete remission rate in adult patients with relapsed B-precursor ALL: Updated Results of an ongoing phase II trial, Blood, American Society of Hematology, US, 118:252 (2011).
Troyer et al., Detection and characterization of the prostate-specific membrane antigen (PSMA) in tissue extracts and body fluids, Int. J. Cancer, 62:552-558 (1995).
U.S. Appl. No. 08/155,301, Lonberg et al.
U.S. Appl. No. 08/161,739, Lonberg et al.
U.S. Appl. No. 08/165,699, Lonberg et al.
U.S. Appl. No. 08/376,279, Kucherlapati et al.
U.S. Appl. No. 08/462,837, Kucherlapati et al.
U.S. Appl. No. 08/464,584, Kucherlapati et al.
U.S. Appl. No. 08/486,853, Kucherlapati et al.
U.S. Appl. No. 08/486,859, Kucherlapati et al.
U.S. Patent Application filed on Apr. 27, 1995, by Kucherlapati et al., U.S. Appl. No. 08/430,938.
U.S. Patent Application filed on Apr. 28, 1994, by Kucherlapati et al., U.S. Appl. No. 08/234,145.
U.S. Patent Application filed on Aug. 27, 1993, by Kucherlapati et al., U.S. Appl. No. 08/112,848.
U.S. Patent Application filed on Aug. 29, 1990, by Kay et al., U.S. Appl. No. 07/574,748.
U.S. Patent Application filed on Aug. 31, 1990, by Lonberg et al., U.S. Appl. No. 07/575,962.
U.S. Patent Application filed on Dec. 3, 1996, by Jakobovits et al., U.S. Appl. No. 08/759,620.
U.S. Patent Application filed on Jan. 12, 1990, by Kucherlapati et al., U.S. Appl. No. 07/466,008.
U.S. Patent Application filed on Jul. 24, 1992, by Kucherlapati et al., U.S. Appl. No. 07/919,297.
U.S. Patent Application filed on Jun. 5, 1995, by Kucherlapati et al., U.S. Appl. No. 08/463,191.
U.S. Patent Application filed on Jun. 23, 1990, by Lonbera et al., U.S. Appl. No. 07/904,068.
U.S. Patent Application filed on Mar. 9, 1994, by Kay et al., U.S. Appl. No. 08/209,741.
U.S. Patent Application filed on Nov. 8, 1990, by Kucherlapati et al., U.S. Appl. No. 07/610,515.
Urlaub et al., Isolation of Chinese hamster cell mutants deficient in dihydrofolate reductase activity. Proc. Natl. Acad. Sci. USA, 77: 4216-20 (1980).
Walter RB, Investigational CD33-targeted therapeutics for acute myeloid leukemia, Expert Opin. Investig. Drugs, 27:339-348 (2018).
Ward et al., Binding activities of a repertoire of single immunoglobulin variable domains secreted from *Escherichia coli*, Nature, 341:544-546 (1989).
Wells, Additivity of mutational effects in proteins, Biochemistry, 29(37):8509-8517 (1990).
Wikstrand et al., Monoclonal antibodies against EGFRvIII are tumor specific and react with breast and luna carcinomas and malignant gliomas, Cancer Res., 55(14):3140-3148 (1995).
Wright et al., Upregulation of prostate-specific membrane antigen after androgen-deprivation therapy, Urology, 48:326-334 (1996).
Wu et al., Humanization of a murine monoclonal antibody by simultaneous optimization of framework and CDR residues, J. Mol. Biol., 294: 151-62 (1999).
Yeung et al., An Optimized Full-Length FLT3/CD3 Bispecific Antibody Demonstrates Potent Anti-leukemia Activity and Reversible Hematological Toxicity, Mol. Ther., S1525-0016(20)30009-5 (2020).
Yuan et al., A novel mycobacterial Hsp70-containing fusion protein targeting mesothelin augments antitumor immunity and prolongs survival in murine models of ovarian cancer and mesothelioma, J. Hematol. Oncol., 7:1-14 (2014).
Zhou et al., Single chain Fc-dimer-human growth hormone fusion protein for improved drug delivery, Biomaterials, 117:24-31 (2017).
Zou et al., Immunotherapy based on bispecific T-cell engager with hIgG1 Fc sequence as a new therapeutic strategy in multiple myeloma, Cancer Sci., 106(5):512-521 (2015).
Zugmaier et al., Clinical overview of anti-CD19 BiTE(Registered) and ex vivo data from anti-CD33 BiTE(Registered) as examples for retargeting T cells in hematologic malignancies, Mol. Immunol., 67:58-66 (2015).
Hoffman et al., Blinatumomab, a bi-specific anti-CD19/CD3 BiTE antibody for the treatment of acute lymphoblastic leukemia: perspectives and current pediatric applications, Frontiers in Oncology, vol. 4, Article 63 (Mar. 2014).
Jazayeri et al., Half-life extension by fusion to the Fc Region, Chapter 9 IN: Kontermann (ed.), Therapeutic Proteins: Strategies to Modulate Their Plasma Half-Lives, First Edition, Wiley-VCH Verlag GmbH & Co KGaA (2012).
Laszlo et al., T-cell ligands modulate the cytolytic activity of the CD33/CD3 BiTE antibody construct, AMG 330, Blood Cancer Journal, 5:e350 (2015).
Unverdorben, Immunoglobulin-based strategies for half-life extension of recombinant proteins, PhD Thesis, Universitat Stuttgart (2015).
Hmiel et al., "Post-translational structural modifications of immunoglobulin G and their effect on biological activity," Anal Bioanal Chem. (2015) 407(1):79-94.
Kontermann, "Strategies to extend plasma half-lives of recombinant antibodies," BioDrugs (2009) 23(2):93-109.
Wang et al., "Antibody Structure, Instability, and Formulation," Journal of Pharmaceutical Sciences (2007) 96(1): 1-26.
Wang et al., "Potential aggregation prone regions in biotherapeutics: A survey of commercial monoclonal antibodies," MAbs (2009) 1(3):254-67.
Werle et al., "Strategies to improve plasma half life time of peptide and protein drugs," Amino Acids (2006) 30 (4):351-67.
Engler et al., A One Pot, One Step, Precision Cloning Method with High Throughput Capability, PLoS One, 3(11): e3647 (2008).
Fan et al., Bispecific antibodies and their applications, J. Hematol. Oncol., 8:130 (2015).
Goldstein et al., AMG 701 induces cytotoxicity of multiple myeloma cells and depletes plasma cells in cynomologus monkeys, Blood Advances, 4(17):4180-4194 (2020).
Gong et al., Engineered human antibody constant domains with increased stability, Journal of Biological Chemistry, 284(21): 14203-14210 (2009).
Guo et al., Cloning PCR Products, Methods in Molecular Biology, 192:111-119 (2002).
Hagner et al., Targeting B-Cell Maturation Antigen (BCMA) with CC-93269, a 2+1 T Cell Engager, Elicits Significant Apoptosis in Diffuse Large B-Cell Lymphoma Preclinical Models, Blood, 134(Suppl. 1): 1580 (2019).
Jefferis et al., Isotype and glycoform selection for antibody therapeutics, Archives of Biochemistry and Biophysics, 526(2): 159-166 (2012).
Kamakura et al., T cell bispecific antibodies: an antibody-based delivery system for inducing antitumor immunity, Pharmaceuticals, 14(11): 1172 (2021).
Lancman et al., Bispecific Antibodies in Multiple Myeloma: Present and Future, Blood Cancer Discovery, 2:423-33 (2021).
Pyzik et al., FcRn: the architect behind the immune and non-immune functions of IgG and albumin, The Journal of Immunology, 194(10):4595-4603 (2015).

(56) References Cited

OTHER PUBLICATIONS

Rath et al., Fc-fusion proteins and FcRn: structural insights for longer-lasting and more effective therapeutics, Critical Reviews in Biotechnology, 35(2):235-254 (2015).
Schaefer et al., Immunoglobulin domain crossover as a generic approach for the production of bispecific IgG antibodies, Proceedings of the National Academy of Sciences, 108(27): 11187-11192 (2011).
Tiller et al., Advances in antibody design, Annual Review of Biomedical Engineering, 17(1): 191-216 (2015).
Vidarsson et al., IgG subclasses and allotypes: from structure to effector functions, Frontiers in Immunology, 5 (520): 1-17 (2014).
Wu et al., Blinatumomab: a bispecific T cell engager (BiTE) antibody against CD19/CD3 for refractory acute lymphoid leukemia, Journal of Hematology & Oncology, 8:104, 2015.

* cited by examiner c) Bispecific X-body construct d) Bispecific human albumin fusion construct Donor 2

Donor 3

Donor 1

Donor 2

Donor 2

Donor 3

Donor 2

Donor 3

Donor 3

Donor 1

Donor 2

Donor 3

Donor 3

BISPECIFIC T CELL ENGAGING ANTIBODY CONSTRUCTS

CROSS-REFERENCE TO RELATED APPLICATIONS

This application is a division of U.S. application Ser. No. 15/422,647, filed Feb. 2, 2017, now issued U.S. Pat. No. 11,434,302, which claims priority to U.S. provisional application No. 62/290,861, filed Feb. 3, 2016.

This application includes a sequence listing submitted electronically by the file name 50401B_Seqlisting.XML; Size: 2,409,217 bytes; Created: Jan. 25, 2023, and is incorporated herein by reference.

BACKGROUND

Bispecific molecules such as BiTE® (bispecific T cell engager) antibody constructs are recombinant protein constructs made from two flexibly linked antibody derived binding domains. One binding domain of BiTE® antibody constructs is specific for a selected tumor-associated surface antigen on target cells; the second binding domain is specific for CD3, a subunit of the T cell receptor complex on T cells. By their particular design BiTE® antibody constructs are uniquely suited to transiently connect T cells with target cells and, at the same time, potently activate the inherent cytolytic potential of T cells against target cells. An important further development of the first generation of BiTE® antibody constructs (see WO 99/54440 and WO 2005/040220) developed into the clinic as AMG 103 and AMG 110 was the provision of bispecific antibody constructs binding to a context independent epitope at the N-terminus of the CD3ε chain (WO 2008/119567). BiTE® antibody constructs binding to this elected epitope do not only show cross-species specificity for human and *Callithrix jacchus, Saguinus oedipus* or *Saimiri sciureus* CD3ε chain, but also, due to recognizing this specific epitope instead of previously described epitopes for CD3 binders in bispecific T cell engaging molecules, do not unspecifically activate T cells to the same degree as observed for the previous generation of T cell engaging antibodies. This reduction in T cell activation was connected with less or reduced T cell redistribution in patients, which was identified as a risk for side effects.

Antibody constructs as described in WO 2008/119567 are likely to suffer from rapid clearance from the body; thus, whilst they are able to reach most parts of the body rapidly, and are quick to produce and easier to handle, their in vivo applications may be limited by their brief persistence in vivo. Prolonged administration by continuous intravenous infusion was used to achieve therapeutic effects because of the short in vivo half life of this small, single chain molecule. However, such continuous intravenous infusions are classified as inconvenient for the patients and, thus, in case of more convenient alternative treatment approaches, hamper the election of the compound demonstrated to be more efficient in the treatment of the respective disease. Hence, there is a need in the art for bispecific therapeutics that retain similar therapeutic efficacy that have a format which is straightforward to produce, and that have favorable pharmacokinetic properties, including a longer half-life.

An increased half-life is generally useful in in vivo applications of immunoglobulins, especially antibodies and most especially antibody fragments of small size. Approaches described in the art to achieve such effect comprise the fusion of the small bispecific antibody construct to larger proteins, which preferably do not interfere with the therapeutic effect of the BiTE® antibody construct. Examples for such further developments of bispecific T cell engagers comprise bispecific Fc-molecules e.g. described in US 2014/0302037, US 2014/0308285, WO 2014/144722, WO 2014/151910 and WO 2015/048272. An alternative strategy is the use of HSA fused to the bispecific molecule or the mere fusion of human albumin binding peptides (see e.g. WO2013/128027, WO2014/140358).

SUMMARY

All the half-life extending formats (HLE formats) of bispecific T cell engaging molecules described in the art, which included the hetero Fc (also designated as hetFc or heterodimeric Fc, hFc) format and the fusion of human serum albumin (also designated as HSA or hALB) had individual disadvantages such as unspecific T cell activation, complement activation, instability or a pharmacokinetic profile, which does not meet the desired half-life prolongation of the molecules. It is thus the object of the present invention to provide a half-life extending format of bispecific T cell engaging molecules, which overcomes at least one and, of course, preferably more than one of these individual defects observed for the state of the art molecules. Accordingly, the present invention provides bispecific antibody constructs of a specific Fc modality characterized by comprising a first domain binding to a target cell surface antigen, a second domain binding to an extracellular epitope of the human and/or the *Macaca* CD3ε chain and a third domain, which is the specific Fc modality. Moreover, the invention provides a polynucleotide encoding the antibody construct, a vector comprising this polynucleotide, host cells expressing the construct and a pharmaceutical composition comprising the same.

DESCRIPTION OF THE FIGURES

FIG. 1A shows a diagram of one embodiment of an antibody construct of the invention. FIG. 1B shows a heterodimeric Fc antibody construct and FIG. 1C shows an X-body construct described in the art. The indicated charged pairs are introduced in order to enforce the heterodimerization. FIG. 1D shows the fusion of an antibody construct with a human serum albumin (HSA or hALB).

FIG. 2A—antibody construct of the invention in 48 h activation assay with human PBMC (3×); HLE BiTE®serial dilutions (start 20 nM; 1:5, 7x+blank); w/o or with FcR blocking [10 mg/mL hulgG (Kiovog, Baxter)]; FACS measurement of CD69 and CD25 [not shown] expression on $CD4^+$, $CD8^+$ T cells. FIG. 2B—Hetero-Fc antibody construct in 48 h activation assay with human PBMC and $CD14^+$/$CD33^+$ cell depleted PBMC (3×); HLE BiTE® serial dilutions (start 20 nM; 1:5, 7x+blank); FACS measurement of CD69 and CD25 [not shown] expression on $CD4^+$, $CD8^+$ T cells.

FIG. 3A—CDH19 antibody construct of the invention in 48 h activation assay with human PBMC (3×); HLE BiTE® serial dilutions (start 20 nM; 1:5, 7x+blank); w/o or with FcR blocking [10 mg/mL hulgG (Kiovog, Baxter)]; FACS measurement of CD69 and CD25 [not shown] expression on $CD4^+$, $CD8^+$ T cells. FIGS. 3D-3AB—Isolated PBMC from three different healthy human donors were cultured with increasing concentrations of HLE bispecific antibody constructs specific for various target antigens for 48 h. The expression of the activation marker CD69 on $CD4^+$ and $CD8^+$ T cells was determined by flow cytometric analysis using a PE-Cy7 conjugated mab specific for CD69.

DETAILED DESCRIPTION

Figure 1B:
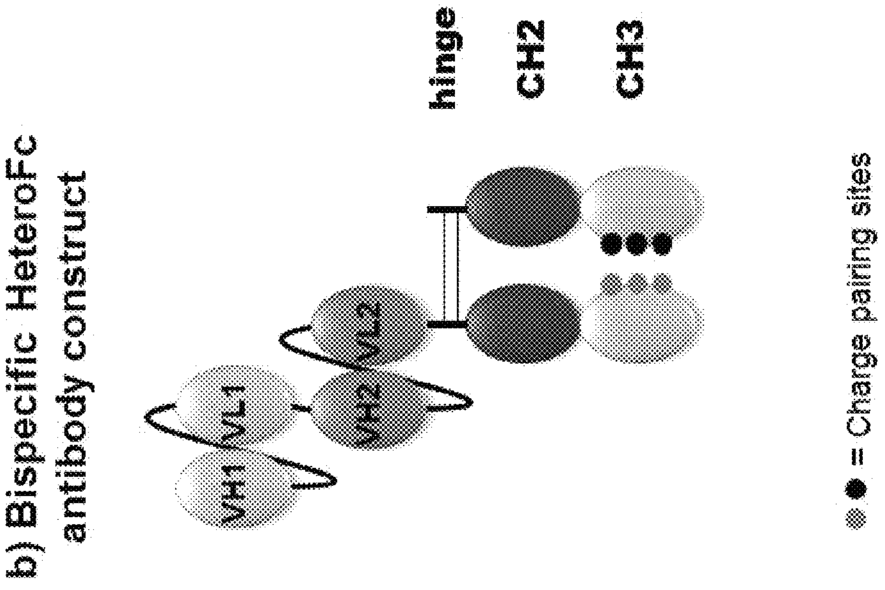
FIGS. 1A-1D.
Figure 1A:
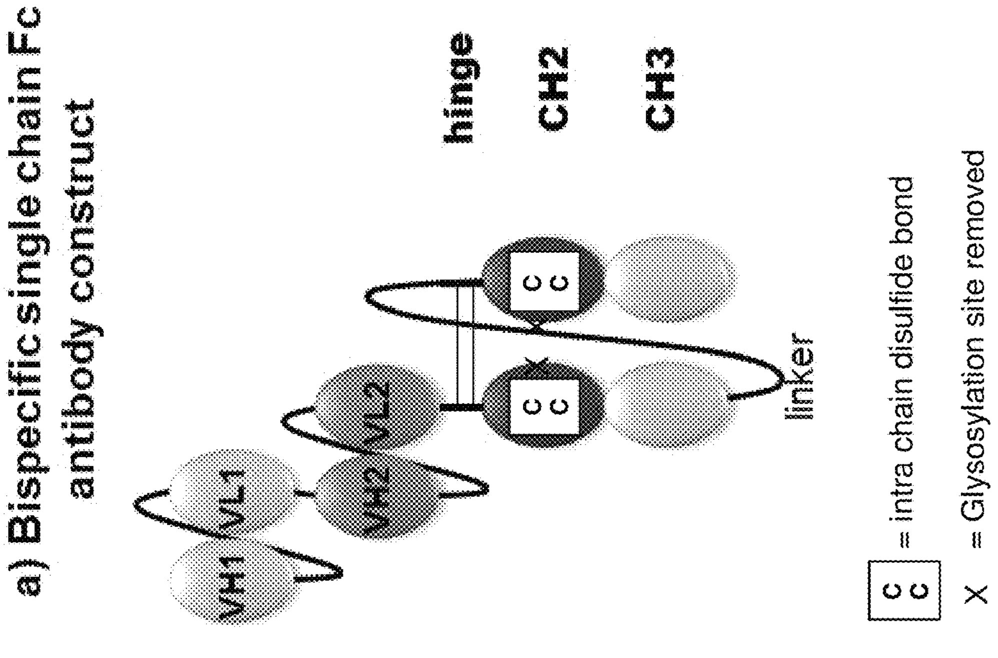
Figure 1C:
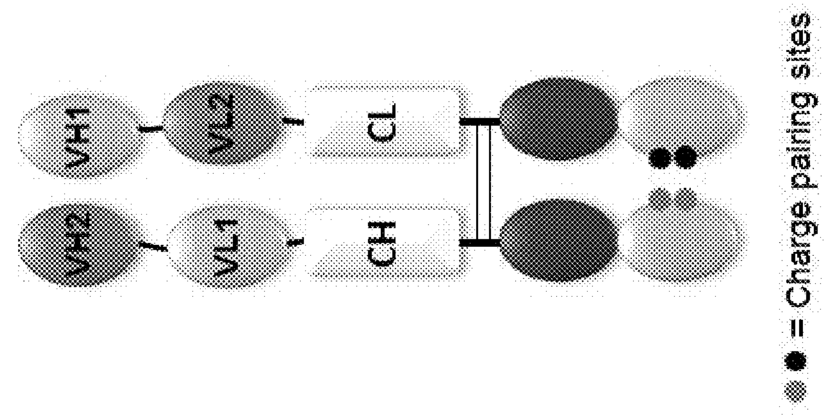
Figure 1D:
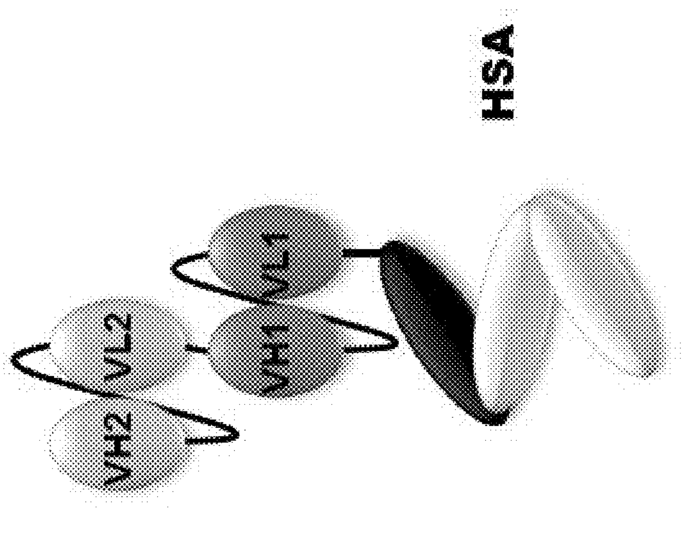

In addition to the significantly prolonged half-life of bispecific antibody constructs of the invention the fusion of the specific Fc modality, i.e., the third domain according to the present invention, is also responsible for a surprising significant impact on the first and second binding domain of the antibody construct of the invention. Thus, while other half-life extending modalities of T cell engaging antibody constructs show individual preferred features the election of the present specific Fc modality allows for the provision of bispecific molecules, which show a broad spectrum of preferred characteristics of a robust molecular format and, thus, allow for the development of promising pharmaceutical compositions.

Thus, the present invention provides an antibody construct comprising at least three domains, wherein the first domain binds to a target cell surface antigen, the second domain binds to an extracellular epitope of the human and/or the *Macaca* CD3ε chain; and the third domain comprises two polypeptide monomers, each comprising a hinge domain, a CH2 domain and a CH3 domain, wherein said two polypeptide monomers are fused to each other via a peptide linker.

The term "antibody construct" refers to a molecule in which the structure and/or function is/are based on the structure and/or function of an antibody, e.g., of a full-length or whole immunoglobulin molecule and/or is/are drawn from the variable heavy chain (VH) and/or variable light chain (VL) domains of an antibody or fragment thereof. An antibody construct is hence capable of binding to its specific target or antigen. Furthermore, the binding domain of an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. An alternative approach to define the minimal structure requirements of an antibody is the definition of the epitope of the antibody within the structure of the specific target, respectively, the protein domain of the target protein composing the epitope region (epitope cluster) or by reference to an specific antibody competing with the epitope of the defined antibody. The antibodies on which the constructs according to the invention are based include for example monoclonal, recombinant, chimeric, deimmunized, humanized and human antibodies.

The binding domain of an antibody construct according to the invention may e.g. comprise the above referred groups of CDRs. Preferably, those CDRs are comprised in the framework of an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a $F(ab')_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Also within the definition of "binding domain" or "domain which binds" are fragments of full-length antibodies, such as VH, VHH, VL, (s)dAb, Fv, Fd, Fab, Fab', F(ab')2 or "r IgG" ("half antibody"). Antibody constructs according to the invention may also comprise modified fragments of antibodies, also called antibody variants, such as scFv, di-scFv or bi(s)-scFv, scFv-Fc, scFv-zipper, scFab, $Fab_2$, Fabs, diabodies, single chain diabodies, tandem diabodies (Tandab's), tandem di-scFv, tandem tri-scFv, "multibodies" such as triabodies or tetrabodies, and single domain antibodies such as nanobodies or single variable domain antibodies comprising merely one variable domain, which might be VHH, VH or VL, that specifically bind an antigen or epitope independently of other V regions or domains.

As used herein, the terms "single-chain Fv," "single-chain antibodies" or "scFv" refer to single polypeptide chain antibody fragments that comprise the variable regions from both the heavy and light chains, but lack the constant regions. Generally, a single-chain antibody further comprises a polypeptide linker between the VH and VL domains which enables it to form the desired structure which would allow for antigen binding. Single chain antibodies are discussed in detail by Pluckthun in The Pharmacology of Monoclonal Antibodies, vol. 113, Rosenburg and Moore eds. Springer-Verlag, New York, pp. 269-315 (1994). Various methods of generating single chain antibodies are known, including those described in U.S. Pat. Nos. 4,694,778 and 5,260,203; International Patent Application Publication No. WO 88/01649; Bird (1988) Science 242:423-442; Huston et al. (1988) Proc. Natl. Acad. Sci. USA 85:5879-5883; Ward et al. (1989) Nature 334:54454; Skerra et al. (1988) Science 242:1038-1041. In specific embodiments, single-chain antibodies can also be bispecific, multispecific, human, and/or humanized and/or synthetic.

Furthermore, the definition of the term "antibody construct" includes monovalent, bivalent and polyvalent/multivalent constructs and, thus, bispecific constructs, specifically binding to only two antigenic structure, as well as polyspecific/multispecific constructs, which specifically bind more than two antigenic structures, e.g. three, four or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The term "bispecific" as used herein refers to an antibody construct which is "at least bispecific", i.e., it comprises at least a first binding domain and a second binding domain, wherein the first binding domain binds to one antigen or target (here: the target cell surface antigen), and the second binding domain binds to another antigen or target (here: CD3). Accordingly, antibody constructs according to the invention comprise specificities for at least two different antigens or targets. For example, the first domain does preferably not bind to an extracellular epitope of CD3ε of one or more of the species as described herein. The term "target cell surface antigen" refers to an antigenic structure expressed by a cell and which is present at the cell surface such that it is accessible for an antibody construct as described herein. It may be a protein, preferably the extracellular portion of a protein, or a carbohydrate structure, preferably a carbohydrate structure of a protein, such as a glycoprotein. It is preferably a tumor antigen. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sides with different specificities. Bispecific antibody constructs can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains (VH/VL) of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. The peptide linkers can also be used to fuse the third domain to the other domains of the antibody construct of the invention. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic side or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target cell surface antigen, (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et a. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dubel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetic diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sides (e. g. 6-7 sides) are mutated to generate all possible amino acid substitutions at each side. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sides for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human target cell surface antigen. Such contact residues and neighboring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. Sci U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or side-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein, however, also contemplates "fully human antibodies", which include only non-artificially and/or genetically altered human sequences of antibodies as those can be derived by using technologies or systems such as the Xenomouse. Preferably, a "fully human antibody" does not include amino acid residues not encoded by human germline immunoglobulin sequences In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target side on the target molecules (antigens), e.g. CD33 and CD3, respectively. The structure and function of the first binding domain (recognizing e.g. CD33), and preferably also the structure and/or function of the second binding domain (recognizing CD3), is/are based on the structure and/or function of an antibody, e.g. of a full-length or whole immunoglobulin molecule and/or is/are drawn from the variable heavy chain (VH) and/or variable light chain (VL) domains of an antibody or fragment thereof. Preferably the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids).

The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a heteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to the target cell surface antigen and/or the binding domain which binds to CD3ε is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XenoMouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430, 938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545, 807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023.010 to Krimpenfort and Berns, U.S. Pat. Nos. 5,612,205; 5,721, 367; and U.S. Pat. No. 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853, 408, Ser. No. 07/904,068, Ser. No. 07/990,860, Ser. No. 08/053,131, Ser. No. 08/096,762, Ser. No. 08/155,301, Ser. No. 08/161,739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against the target cell surface antigen and a human binding domain against CD3ε in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with a given epitope or a given target side on the target molecules (antigens), here: target cell surface antigen and CD3C, respectively.

The term "epitope" refers to a side on an antigen to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction side". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for one of the binding domains is comprised within the target cell surface antigen protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human target cell surface antigen protein is exchanged/replaced with its corresponding region of a non-human and non-primate target cell surface antigen (e.g., mouse target cell surface antigen, but others like chicken, rat, hamster, rabbit etc. might also be conceivable), a decrease in the binding of the binding domain is expected to occur, unless the binding domain is cross-reactive for the non-human, non-primate target cell surface antigen used. Said decrease is preferably at least 10%, 20%, 30%, 40%, or 50%; more preferably at least 60%, 70%, or 80%, and most preferably 90%, 95% or even 100% in comparison to the binding to the respective region in the human target cell surface antigen protein, whereby binding to the respective region in the human target cell surface antigen protein is set to be 100%. It is envisaged that the aforementioned human target cell surface antigen/non-human target cell surface antigen chimeras are expressed in CHO cells. It is also envisaged that the human target cell surface antigen/non-human target cell surface antigen chimeras are fused with a transmembrane domain and/or cytoplasmic domain of a different membrane-bound protein such as EpCAM.

In an alternative or additional method for epitope mapping, several truncated versions of the human target cell surface antigen extracellular domain can be generated in order to determine a specific region that is recognized by a binding domain. In these truncated versions, the different extracellular target cell surface antigen domains/sub-domains or regions are stepwise deleted, starting from the N-terminus. It is envisaged that the truncated target cell surface antigen versions may be expressed in CHO cells. It is also envisaged that the truncated target cell surface antigen versions may be fused with a transmembrane domain and/or cytoplasmic domain of a different membrane-bound protein such as EpCAM. It is also envisaged that the truncated target cell surface antigen versions may encompass a signal peptide domain at their N-terminus, for example a signal peptide derived from mouse IgG heavy chain signal peptide. It is furthermore envisaged that the truncated target cell surface antigen versions may encompass a v5 domain at their N-terminus (following the signal peptide) which allows verifying their correct expression on the cell surface. A decrease or a loss of binding is expected to occur with those truncated target cell surface antigen versions which do not encompass any more the target cell surface antigen region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human target cell surface antigen protein (or its extracellular region or domain) is set to be 100.

A further method to determine the contribution of a specific residue of a target cell surface antigen to the recognition by an antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: target cell surface antigen and CD3, respectively) and, generally, does not exhibit significant reactivity with proteins or antigens other than the target cell surface antigen or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than the target cell surface antigen or CD3. Preferably, a binding domain of the invention does not essentially or substantially bind to proteins or antigens other than the target cell surface antigen or CD3 (i.e., the first binding domain is not capable of binding to proteins other than the target cell surface antigen and the second binding domain is not capable of binding to proteins other than CD3). It is an envisaged characteristic of the antibody constructs according to the present invention to have superior affinity characteristics in comparison to other HLE formats. Such a superior affinity, in consequence, suggests a prolonged half-life in vivo. The longer half-life of the antibody constructs according to the present invention may reduce the duration and frequency of administration which typically contributes to improved patient compliance. This is of particular importance as the antibody constructs of the present invention are particularly beneficial for highly weakened or even multimorbide cancer patients.

The term "does not essentially/substantially bind" or "is not capable of binding" means that a binding domain of the present invention does not bind a protein or antigen other than the target cell surface antigen or CD3, i.e., does not show reactivity of more than 30%, preferably not more than 20%, more preferably not more than 10%, particularly preferably not more than 9%, 8%, 7%, 6% or 5% with proteins or antigens other than the target cell surface antigen or CD3, whereby binding to the target cell surface antigen or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-side with its specific antigen may result in a simple binding of said side to the antigen. Moreover, the specific interaction of the antigen-interaction-side with its specific antigen may alternatively or additionally result in the initiation of a signal, e.g. due to the induction of a change of the conformation of the antigen, an oligomerization of the antigen, etc.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding side.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding side (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding side is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding side. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant (C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{1}0$ different antibody molecules (Immunoglobulin Genes, 2nd ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "Fc portion" or "Fc monomer" means in connection with this invention a polypeptide comprising at least one domain having the function of a CH2 domain and at least one domain having the function of a CH3 domain of an immunoglobulin molecule. As apparent from the term "Fc monomer", the polypeptide comprising those CH domains is a "polypeptide monomer". An Fc monomer can be a polypeptide comprising at least a fragment of the constant region of an immunoglobulin excluding the first constant region immunoglobulin domain of the heavy chain (CH1), but maintaining at least a functional part of one CH2 domain and a functional part of one CH3 domain, wherein the CH2 domain is amino terminal to the CH3 domain. In a preferred aspect of this definition, an Fc monomer can be a polypeptide constant region comprising a portion of the Ig-Fc hinge region, a CH2 region and a CH3 region, wherein the hinge region is amino terminal to the CH2 domain. It is envisaged that the hinge region of the present invention promotes dimerization. Such Fc polypeptide molecules can be obtained by papain digestion of an immunoglobulin region (of course resulting in a dimer of two Fc polypeptide), for example and not limitation. In another aspect of this definition, an Fc monomer can be a polypeptide region comprising a portion of a CH2 region and a CH3 region. Such Fc polypeptide molecules can be obtained by pepsin digestion of an immunoglobulin molecule, for example and not limitation. In one embodiment, the polypeptide sequence of an Fc monomer is substantially similar to an Fc polypeptide sequence of: an $IgG_1$ Fc region, an $IgG_2$ Fc region, an $IgG_3$ Fc region, an $IgG_4$ Fc region, an IgM Fc region, an IgA Fc region, an IgD Fc region and an IgE Fc region. (See, e.g., Padlan, Molecular Immunology, 31(3), 169-217 (1993)). Because there is some variation between immunoglobulins, and solely for clarity, Fc monomer refers to the last two heavy chain constant region immunoglobulin domains of IgA, IgD, and IgG, and the last three heavy chain constant region immunoglobulin domains of IgE and IgM. As mentioned, the Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion may vary an example for a human IgG heavy chain Fc portion comprising a functional hinge, CH2 and CH3 domain can be defined e.g. to comprise residues D231 (of the hinge domain—corresponding to D234 in Table 1 below)) to P476, respectively L476 (for $IgG_4$) of the carboxyl-terminus of the CH3 domain, wherein the numbering is according to Kabat. The two Fc portions or Fc monomers, which are fused to each other via a peptide linker define the third domain of the antibody construct of the invention, which may also be defined as scFc domain.

In one embodiment of the invention it is envisaged that a scFc domain as disclosed herein, respectively the Fc monomers fused to each other are comprised only in the third domain of the antibody construct.

In line with the present invention an IgG hinge region can be identified by analogy using the Kabat numbering as set forth in Table 1. In line with the above, it is envisaged that a hinge domain/region of the present invention comprises the amino acid residues corresponding to the $IgG_1$ sequence stretch of D234 to P243 according to the Kabat numbering. It is likewise envisaged that a hinge domain/region of the present invention comprises or consists of the IgG1 hinge sequence DKTHTCPPCP (SEQ ID NO: 1449) (corresponding to the stretch D234 to P243 as shown in Table 1 below—variations of said sequence are also envisaged provided that the hinge region still promotes dimerization). In a preferred embodiment of the invention the glycosylation site at Kabat position 314 of the CH2 domains in the third domain of the antibody construct is removed by a N314X substitution, wherein X is any amino acid excluding Q. Said substitution is preferably a N314G substitution. In a more preferred embodiment, said CH2 domain additionally comprises the following substitutions (position according to Kabat) V321C and R309C (these substitutions introduce the intra domain cysteine disulfide bridge at Kabat positions 309 and 321).

It is also envisaged that the third domain of the antibody construct of the invention comprises or consists in an amino to carboxyl order: DKTHTCPPCP (SEQ ID NO: 1449) (i.e. hinge) —CH2-CH3-linker-DKTHTCPPCP (SEQ ID NO: 1449) (i.e. hinge) —CH2-CH3. The peptide linker of the aforementioned antibody construct is in a preferred embodiment characterized by the amino acid sequence Gly-Gly-Gly-Gly-Ser, i.e. $Gly_4Ser$ (SEQ ID NO: 1), or polymers thereof, i.e. $(Gly_4Ser)x$, where x is an integer of 5 or greater (e.g. 5, 6, 7, 8 etc. or greater), 6 being preferred ((Gly4Ser) 6). Said construct may further comprise the aforementioned substitutions N314X, preferably N314G, and/or the further substitutions V321C and R309C.

In a preferred embodiment of the antibody constructs of the invention as defined herein before, it is envisaged that the second domain binds to an extracellular epitope of the human and/or the *Macaca* CD3ε chain.

TABLE 1

| Kabat numbering of the amino acid residues of the hinge region | | |
|---|---|---|
| IMGT numbering for the hinge | $IgG_1$ amino acid translation | Kabat numbering |
| 1 | (E) | 226 |
| 2 | P | 227 |
| 3 | K | 228 |
| 4 | S | 232 |
| 5 | C | 233 |
| 6 | D | 234 |
| 7 | K | 235 |
| 8 | T | 236 |
| 9 | H | 237 |
| 10 | T | 238 |
| 11 | C | 239 |
| 12 | P | 240 |
| 13 | P | 241 |
| 14 | C | 242 |
| 15 | P | 243 |

In further embodiments of the present invention, the hinge domain/region comprises or consists of the IgG2 subtype hinge sequence ERKCCVECPPCP (SEQ ID NO: 1450), the IgG3 subtype hinge sequence ELKTPLDTTHTCPRCP (SEQ ID NO: 1451) or ELKTPLGDTTHTCPRCP (SEQ ID NO: 1458), and/or the IgG4 subtype hinge sequence ESKYGPPCPSCP (SEQ ID NO: 1452). The IgG1 subtype hinge sequence may be the following one EPKSCDKTHTCPPCP (as shown in Table 1 and SEQ ID NO: 1459). These core hinge regions are thus also envisaged in the context of the present invention.

The location and sequence of the IgG CH2 and IgG CD3 domain can be identified by analogy using the Kabat numbering as set forth in Table 2:

TABLE 2

Kabat numbering of the amino acid residues of the IgG CH2 and CH3 region

| IgG subtype | CH2 aa translation | CH2 Kabat numbering | CH3 aa translation | CH3 Kabat numbering |
|---|---|---|---|---|
| $IgG_1$ | AP*E* . . . *KA*K | 244 . . . 360 | GQP . . . ***P*GK** | 361 . . . 478 |
| $IgG_2$ | AP*P* . . . *KT*K | 244 . . . 360 | GQP . . . ***P*GK** | 361 . . . 478 |
| $IgG_3$ | AP*E* . . . *KT*K | 244 . . . 360 | GQP . . . ***P*GK** | 361 . . . 478 |
| $IgG_4$ | AP*E* . . . *KA*K | 244 . . . 360 | GQP . . . ***L*GK** | 361 . . . 478 |

In one embodiment of the invention the emphasized bold amino acid residues in the CH3 domain of the first or both Fc monomers are deleted.

The peptide linker, by whom the polypeptide monomers ("Fc portion" or "Fc monomer") of the third domain are fused to each other, preferably comprises at least 25 amino acid residues (25, 26, 27, 28, 29, 30 etc.). More preferably, this peptide linker comprises at least 30 amino acid residues (30, 31, 32, 33, 34, 35 etc.). It is also preferred that the linker comprises up to 40 amino acid residues, more preferably up to 35 amino acid residues, most preferably exactly 30 amino acid residues. A preferred embodiment of such peptide linker is characterized by the amino acid sequence Gly-Gly-Gly-Gly-Ser, i.e. $Gly_4Ser$ (SEQ ID NO: 1), or polymers thereof, i.e. $(Gly_4Ser)x$, where x is an integer of 5 or greater (e.g. 6, 7 or 8). Preferably the integer is 6 or 7, more preferably the integer is 6.

In the event that a linker is used to fuse the first domain to the second domain, or the first or second domain to the third domain, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A preferred embodiment of the peptide linker for a fusion the first and the second domain is depicted in SEQ ID NO:1. A preferred linker embodiment of the peptide linker for a fusion the second and the third domain is a $(Gly)_4$-linker, respectively $G_4$-linker.

A particularly preferred "single" amino acid in the context of one of the above described "peptide linker" is Gly. Accordingly, said peptide linker may consist of the single amino acid Gly. In a preferred embodiment of the invention a peptide linker is characterized by the amino acid sequence Gly-Gly-Gly-Gly-Ser, i.e. $Gly_4Ser$ (SEQ ID NO: 1), or polymers thereof, i.e. $(Gly_4Ser)x$, where x is an integer of 1 or greater (e.g. 2 or 3). Preferred linkers are depicted in SEQ ID NOs: 1 to 12. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

In a preferred embodiment of the antibody construct or the present invention the first and second domain form an antibody construct in a format selected from the group consisting of $(scFv)_2$, scFv-single domain mAb, diabody and oligomers of any of the those formats According to a particularly preferred embodiment, and as documented in the appended examples, the first and the second domain of the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain antibody constructs are known in the art and are described in WO 99/54440, Mack, J. Immunol. (1997), 158, 3965-3970, Mack, PNAS, (1995), 92, 7021-7025, Kufer, Cancer Immunol. Immunother, (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dubel (2010), loc. cit.

and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format $(scFv)_2$ can be engineered by linking two scFv molecules (e.g. with linkers as described hereinbefore). If these two scFv molecules have the same binding specificity, the resulting $(scFv)_2$ molecule will preferably be called bivalent (i.e. it has two valences for the same target epitope). If the two scFv molecules have different binding specificities, the resulting $(scFv)_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8).

In line with this invention either the first, the second or the first and the second domain may comprise a single domain antibody, respectively the variable domain or at least the CDRs of a single domain antibody. Single domain antibodies comprise merely one (monomeric) antibody variable domain which is able to bind selectively to a specific antigen, independently of other V regions or domains. The first single domain antibodies were engineered from heavy chain antibodies found in camelids, and these are called $V_HH$ fragments. Cartilaginous fishes also have heavy chain antibodies (IgNAR) from which single domain antibodies called $V_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain $mAb)_2$ is hence a monoclonal antibody construct composed of (at least) two single domain monoclonal antibodies, which are individually selected from the group comprising $V_H$, $V_L$, $V_HH$ and $V_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Possible means for the read-out includes flow cytometry.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (a) and beta (p) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors.

The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The most preferred epitope of CD3 epsilon is comprised within amino acid residues 1-27 of the human CD3 epsilon extracellular domain. It is envisaged that antibody constructs according to the present invention typically and advantageously show less unspecific T cell activation, which is not desired in specific immunotherapy. This translates to a reduced risk of side effects.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by antibody constructs of the invention can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque target cell surface antigen which is bound by the first domain, the effector cells should also be of macaque origin such as a macaque T cell line, e.g. 4119LnPx. The target cells should express (at least the extracellular domain of) the target cell surface antigen, e.g. human or macaque target cell surface antigen. Target cells can be a cell line (such as CHO) which is stably or transiently transfected with target cell surface antigen, e.g. human or macaque target cell surface antigen. Alternatively, the target cells can be a target cell surface antigen positive natural expresser cell line. Usually $EC_{50}$ values are expected to be lower with target cell lines expressing higher levels of target cell surface antigen on the cell surface. The effector to target cell (E:T) ratio is usually about 10:1, but can also vary. Cytotoxic activity of target cell surface antigenxCD3 bispecific antibody constructs can be measured in a $^{51}Cr$-release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by target cell surface antigenxCD3 bispecific antibody constructs of the present invention is preferably measured in a cell-based cytotoxicity assay. It may also be measured in a $^{51}$Cr-release assay. It is represented by the $EC_{50}$ value, which corresponds to the half maximal effective concentration (concentration of the antibody construct which induces a cytotoxic response halfway between the baseline and maximum). Preferably, the $EC_{50}$ value of the target cell surface antigenxCD3 bispecific antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably ≤5 pM.

The above given $EC_{50}$ values can be measured in different assays. The skilled person is aware that an $EC_{50}$ value can be expected to be lower when stimulated/enriched $CD8^+$ T cells are used as effector cells, compared with unstimulated PBMC. It can furthermore be expected that the $EC_{50}$ values are lower when the target cells express a high number of the target cell surface antigen compared with a low target expression rat. For example, when stimulated/enriched human $CD8^+$ T cells are used as effector cells (and either target cell surface antigen transfected cells such as CHO cells or target cell surface antigen positive human cell lines are used as target cells), the $EC_{50}$ value of the target cell surface antigenxCD3 bispecific antibody construct is preferably ≤1000 pM, more preferably ≤500 pM, even more preferably ≤250 pM, even more preferably ≤100 pM, even more preferably 550 pM, even more preferably ≤10 pM, and most preferably ≤5 pM. When human PBMCs are used as effector cells, the $EC_{50}$ value of the target cell surface antigenxCD3 bispecific antibody construct is preferably ≤5000 pM or ≤4000 pM (in particular when the target cells are target cell surface antigen positive human cell lines), more preferably ≤2000 pM (in particular when the target cells are target cell surface antigen transfected cells such as CHO cells), more preferably ≤1000 pM or ≤500 pM, even more preferably ≤200 pM, even more preferably ≤150 pM, even more preferably ≤100 pM, and most preferably ≤50 pM, or lower. When a macaque T cell line such as LnPx4119 is used as effector cells, and a macaque target cell surface antigen transfected cell line such as CHO cells is used as target cell line, the $EC_{50}$ value of the target cell surface antigenxCD3 bispecific antibody construct is preferably ≤2000 pM or ≤1500 pM, more preferably ≤1000 pM or ≤500 pM, even more preferably ≤300 pM or ≤250 pM, even more preferably ≤100 pM, and most preferably ≤50 pM.

Preferably, the target cell surface antigenxCD3 bispecific antibody constructs of the present invention do not induce/mediate lysis or do not essentially induce/mediate lysis of target cell surface antigen negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of target cell surface antigen negative cells, whereby lysis of a target cell surface antigen positive human cell line is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual target cell surface antigenxCD3 bispecific antibody constructs is referred to as "potency gap". This potency gap can e.g. be calculated as ratio between $EC_{50}$ values of the molecule's monomeric and dimeric form. Potency gaps of the target cell surface antigenxCD3 bispecific antibody constructs of the present invention are preferably ≤5, more preferably ≤4, even more preferably ≤3, even more preferably ≤2 and most preferably ≤1.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human target cell surface antigen and human CD3, respectively, will also bind to target cell surface antigen/CD3 of primates including (but not limited to) new world primates (such as *Callithrix jacchus, Saguinus oedipus* or *Saimiri sciureus*), old world primates (such baboons and macaques), gibbons, and non-human homininae.

In one embodiment of the antibody construct of the invention the first domain binds to human target cell surface antigen and further binds to macaque target cell surface antigen, such as target cell surface antigen of *Macaca fascicularis*, and more preferably, to macaque target cell surface antigen expressed on the surface macaque cells. The affinity of the first binding domain for macaque target cell surface antigen is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque target cell surface antigen versus human target cell surface antigen [ma target cell surface antigen:hu target cell surface antigen](as determined e.g. by BiaCore or by Scatchard analysis) is <100, preferably <20, more preferably <15, further preferably <10, even more preferably <8, more preferably <6 and most preferably <2. Preferred ranges for the affinity gap of the antibody constructs according to the invention for binding macaque target cell surface antigen versus human target cell surface antigen are between 0.1 and 20, more preferably between 0.2 and 10, even more preferably between 0.3 and 6, even more preferably between 0.5 and 3 or between 0.5 and 2.5, and most preferably between 0.5 and 2 or between 0.6 and 2.

The second (binding) domain of the antibody construct of the invention binds to human CD3 epsilon and/or to *Macaca* CD3 epsilon. In a preferred embodiment the second domain further bind to *Callithrix jacchus, Saguinus oedipus* or *Saimiri sciureus* CD3 epsilon. *Callithrix jacchus* and *Saguinus oedipus* are both new world primate belonging to the family of Callitrichidae, while *Saimiri sciureus* is a new world primate belonging to the family of Cebidae.

It is preferred for the antibody construct of the present invention that the second domain which binds to an extracellular epitope of the human and/or the *Macaca* CD3 on the comprises a VL region comprising CDR-L1, CDR-L2 and CDR-L3 selected from:

(a) CDR-L1 as depicted in SEQ ID NO: 1510, CDR-L2 as depicted in SEQ ID NO: 1511 and CDR-L3 as depicted in SEQ ID NO: 1512;

(b) CDR-L1 as depicted in SEQ ID NO: 1513, CDR-L2 as depicted in SEQ ID NO: 1514 and CDR-L3 as depicted in SEQ ID NO: 1515; and (c) CDR-L1 as depicted in SEQ ID NO: 1516, CDR-L2 as depicted in 1517 and CDR-L3 as depicted in SEQ ID NO: 1518.

In an also preferred embodiment of the antibody construct of the present invention, the second domain which binds to an extracellular epitope of the human and/or the *Macaca* CD3 epsilon chain comprises a VH region comprising CDR-H 1, CDR-H2 and CDR-H3 selected from:

(a) CDR-H1 as depicted in SEQ ID NO: 1480, CDR-H2 as depicted in SEQ ID NO: 1481 and CDR-H3 as depicted in SEQ ID NO: 1482;

(b) CDR-H1 as depicted in SEQ ID NO: 1483, CDR-H2 as depicted in SEQ ID NO: 1484 and CDR-H3 as depicted in SEQ ID NO: 1485;

(c) CDR-H1 as depicted in SEQ ID NO: 1486, CDR-H2 as depicted in SEQ ID NO: 1487 and CDR-H3 as depicted in SEQ ID NO: 1488;

(d) CDR-H1 as depicted in SEQ ID NO: 1489, CDR-H2 as depicted in SEQ ID NO: 1490 and CDR-H3 as depicted in SEQ ID NO: 1491;

(e) CDR-H1 as depicted in SEQ ID NO: 1492, CDR-H2 as depicted in SEQ ID NO: 1493 and CDR-H3 as depicted in SEQ ID NO: 1494;

(f) CDR-H1 as depicted in SEQ ID NO: 1495, CDR-H2 as depicted in SEQ ID NO: 1496 and CDR-H3 as depicted in SEQ ID NO: 1497;

(g) CDR-H1 as depicted in SEQ ID NO: 1498, CDR-H2 as depicted in SEQ ID NO: 1499 and CDR-H3 as depicted in SEQ ID NO: 1500;

(h) CDR-H1 as depicted in SEQ ID NO: 1501, CDR-H2 as depicted in SEQ ID NO: 1502 and CDR-H3 as depicted in SEQ ID NO: 1503;

(i) CDR-H1 as depicted in SEQ ID NO: 1504, CDR-H2 as depicted in SEQ ID NO: 1505 and CDR-H3 as depicted in SEQ ID NO: 1506; and (j) CDR-H1 as depicted in SEQ ID NO: 1507, CDR-H2 as depicted in SEQ ID NO: 1508 and CDR-H3 as depicted in SEQ ID NO: 1509.

In a preferred embodiment of the antibody construct of the invention the above described three groups of VL CDRs are combined with the above described ten groups of VH CDRs within the second binding domain to form (30) groups, each comprising CDR-L 1-3 and CDR-H 1-3.

It is preferred for the antibody construct of the present invention that the second domain which binds to CD3 comprises a VL region selected from the group consisting of a VL region comprising an amino acid sequence selected from the group consisting of SEQ ID NO: 1539-1558 and 13.

It is also preferred that the second domain which binds to CD3 comprises a VH region comprising an amino acid sequence selected from the group consisting of SEQ ID NO: 1519-1538 and 14.

More preferably, the antibody construct of the present invention is characterized by a second domain which binds to CD3 comprising a VL region and a VH region selected from the group consisting of:

(a) a VL region as depicted in SEQ ID NO: 1539 or 1540 and a VH region as depicted in SEQ ID NO: 1519 or 1520;

(b) a VL region as depicted in SEQ ID NO: 1541 or 1542 and a VH region as depicted in SEQ ID NO: 1521 or 1522;

(c) a VL region as depicted in SEQ ID NO: 1543 or 1544 and a VH region as depicted in SEQ ID NO: 1523 or 1524;

(d) a VL region as depicted in SEQ ID NO: 1545 or 1546 and a VH region as depicted in SEQ ID NO: 1525 or 1526;

(e) a VL region as depicted in SEQ ID NO: 1547 or 1548 and a VH region as depicted in SEQ ID NO: 1527 or 1528;

(f) a VL region as depicted in SEQ ID NO: 1549 or 1550 and a VH region as depicted in SEQ ID NO: 1529 or 1530;

(g) a VL region as depicted in SEQ ID NO: 1551 or 1552 and a VH region as depicted in SEQ ID NO: 1531 or 1532;

(h) a VL region as depicted in SEQ ID NO: 1553 or 1554 and a VH region as depicted in SEQ ID NO: 1533 or 1534;

(i) a VL region as depicted in SEQ ID NO: 1555 or 1556 and a VH region as depicted in SEQ ID NO: 1535 or 1536; and (j) a VL region as depicted in SEQ ID NO: 1557 or 1558 and a VH region as depicted in SEQ ID NO: 1537 or 1538.

Also preferred in connection with the antibody construct of the present invention is a second domain which binds to CD3 comprising a VL region as depicted in SEQ ID NO: 13 and a VH region as depicted in SEQ ID NO: 14.

According to a preferred embodiment of the antibody construct of the present invention, the first and/or the second domain have the following format: The pairs of VH regions and VL regions are in the format of a single chain antibody (scFv). The VH and VL regions are arranged in the order VH-VL or VL-VH. It is preferred that the VH-region is positioned N-terminally of a linker sequence, and the VL-region is positioned C-terminally of the linker sequence.

A preferred embodiment of the above described antibody construct of the present invention is characterized by the second domain which binds to CD3 comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 1460-1479, respectively, herein) or as depicted in SEQ ID NO: 15.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}I$ or $^{131}I$ to prepare labeled proteins for use in radioimmunoassay, the chloramine T method described above being suitable.

Carboxyl side groups (aspartyl or glutamyl) are selectively modified by reaction with carbodiimides (R'—N═C═N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^{3}H$, $^{14}C$, $^{15}N$, $^{35}S$, $^{89}Zr$, $^{90}Y$, $^{99}Tc$, $^{111}In$, $^{125}I$, $^{131}I$)
b) magnetic labels (e.g., magnetic particles)
c) redox active moieties
d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
e) enzymatic groups (e.g. horseradish peroxidase, β-galactosidase, luciferase, alkaline phosphatase)
f) biotinylated groups
g) predetermined polypeptide epitopes recognized by a secondary reporter (e.g., leucine zipper pair sequences, binding sides for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus*, or *Aequorea* species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and *Renilla* (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs may comprise a His-tag domain, which is generally known as a repeat of consecutive His residues in the amino acid sequence of a molecule, preferably of five, and more preferably of six His residues (hexa-histidine). The His-tag may be located e.g. at the N- or C-terminus of the antibody construct, preferably it is located at the C-terminus. Most preferably, a hexa-histidine tag (HHHHHH) (SEQ ID NO:16) is linked via peptide bond to the C-terminus of the antibody construct according to the invention. Additionally, a conjugate system of PLGA-PEG-PLGA may be combined with a poly-histidine tag for sustained release application and improved pharmacokinetic profile.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acd sequence modifications should result in an antibody construct which still retains the desired biological activity (binding to the target cell surface antigen and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted, substituted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted, substituted or deleted in each of the FRs. Preferably, amino acid sequence insertions into the antibody construct include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. Corresponding modifications may also performed within the third domain of the antibody construct of the invention. An insertional variant of the antibody construct of the invention includes the fusion to the N-terminus or to the C-terminus of the antibody construct of an enzyme or the fusion to a polypeptide.

The sites of greatest interest for substitutional mutagenesis include (but are not limited to) the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions are then refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as the target cell surface antigen or CD3 binding.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 3, below) is envisaged as long as the antibody construct retains its capability to bind to the target cell surface antigen via the first domain and to CD3, respectively CD3 epsilon, via the second domain and/or its CDRs have an identity to the then substituted sequence (at least 60% or 65%, more preferably 70% or 75%, even more preferably 80% or 85%, and particularly preferably 90% or 95% identical to the "original" CDR sequence).

Conservative substitutions are shown in Table 3 under the heading of "preferred substitutions". If such substitutions result in a change in biological activity, then more substantial changes, denominated "exemplary substitutions" in Table 3, or as further described below in reference to amino acid classes, may be introduced and the products screened for a desired characteristic.

TABLE 3

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr, asn, gln; (3) acidic: asp, glu; (4) basic:

his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, *Adv. Appl. Math.* 2:482, the sequence identity alignment algorithm of Needleman and Wunsch, 1970, *J. Mol. Biol.* 48:443, the search for similarity method of Pearson and Lipman, 1988, *Proc. Nat. Acad. Sci. U.S.A.* 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, *Nucl. Acid Res.* 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J. Mol. Evol.* 35:351-360; the method is similar to that described by Higgins and Sharp, 1989, CAB/OS 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, *Nucl. Acids Res.* 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs or VH/VL sequences are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs or VH/VL sequences and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" or a "variant VH/VL region" is one with the specified homology, similarity, or identity to the parent CDR/VH/VL of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR or VH/VL.

In one embodiment, the percentage of identity to human germline of the antibody constructs according to the invention is ≤70% or ≤75%, more preferably ≤80% or ≤85%, even more preferably ≤90%, and most preferably ≤91%, ≤92%, ≤93%, ≤94%, ≤95% or even ≤96%. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In a further embodiment, the bispecific antibody constructs of the present invention exhibit high monomer yields under standard research scale conditions, e.g., in a standard two-step purification process. Preferably the monomer yield of the antibody constructs according to the invention is ≤0.25 mg/L supernatant, more preferably ≤0.5 mg/L, even more preferably ≤1 mg/L, and most preferably ≤3 mg/L supernatant.

Likewise, the yield of the dimeric antibody construct isoforms and hence the monomer percentage (i.e., monomer: (monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≤80%, more preferably 85%, even more preferably ≤90%, and most preferably ≤95%.

In one embodiment, the antibody constructs have a preferred plasma stability (ratio of EC50 with plasma to EC50 w/o plasma) of ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by EC50 determination in a $^{51}$chromium release cytotoxicity assay. The effector cells in the cytotoxicity assay can be stimulated enriched human CD8 positive T cells. Target cells can e.g. be CHO cells transfected with the human target cell surface antigen. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control).

It is furthermore preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤51.5%, and most preferably ≤1% or ≤0.5% or even 0%.

It is also preferred that the bispecific antibody constructs of the present invention present with very low dimer conversion after a number of freeze/thaw cycles. For example, the antibody construct monomer is adjusted to a concentration of 250 µg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤51.5%, and most preferably ≤1% or even ≤0.5%, for example after three freeze/thaw cycles.

The bispecific antibody constructs of the present invention preferably show a favorable thermostability with aggregation temperatures ≥45° C. or ≥50° C., more preferably ≥52° C. or ≥54° C., even more preferably ≥56° C. or ≥57° C., and most preferably ≥58° C. or ≥59° C. The thermostability parameter can be determined in terms of antibody aggregation temperature as follows: Antibody solution at a concentration 250 µg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody.

Alternatively, temperature melting curves can be determined by Differential Scanning Calorimetry (DSC) to determine intrinsic biophysical protein stabilities of the antibody constructs. These experiments are performed using a MicroCal LLC (Northampton, MA, U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

The target cell surface antigenxCD3 bispecific antibody constructs of the invention are also envisaged to have a turbidity (as measured by OD340 after concentration of purified monomeric antibody construct to 2.5 mg/ml and over night incubation) of ≤0.2, preferably of ≤0.15, more preferably of ≤0.12, even more preferably of ≤0.1, and most preferably of ≤0.08.

In a further embodiment the antibody construct according to the invention is stable at physiologic or slightly lower pH, i.e., about pH 7.4 to 6.0. The more tolerant the antibody construct behaves at unphysiologic pH such as about pH 6.0, the higher is the recovery of the antibody construct eluted from an ion exchange column relative to the total amount of loaded protein. Recovery of the antibody construct from an ion (e.g., cation) exchange column at about pH 6.0 is preferably ≤30%, more preferably ≤40%, more preferably ≤≤0%, even more preferably ≤60%, even more preferably ≤70%, even more preferably ≤80%, even more preferably ≤90%, even more preferably ≤95%, and most preferably ≤99%.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

In a preferred embodiment of the antibody construct of the invention the antibody construct is a single chain antibody construct.

Also in a preferred embodiment of the antibody construct of the invention said third domain comprises in an amino to carboxyl order:

hinge-CH2-CH3-linker-hinge-CH2-CH3.

In one embodiment of the invention each of said polypeptide monomers of the third domain has an amino acid sequence that is at least 90% identical to a sequence selected from the group consisting of: SEQ ID NO: 17-24. In a preferred embodiment or the invention each of said polypeptide monomers has an amino acid sequence selected from SEQ ID NO: 17-24.

Also in one embodiment of the invention the CH2 domain of one or preferably each (both) polypeptide monomers of the third domain comprises an intra domain cysteine disulfide bridge. As known in the art the term "cysteine disulfide bridge" refers to a functional group with the general structure R—S—S—R. The linkage is also called an SS-bond or a disulfide bridge and is derived by the coupling of two thiol groups of cysteine residues. It is particularly preferred for the antibody construct of the invention that the cysteines forming the cysteine disulfide bridge in the mature antibody construct are introduced into the amino acid sequence of the CH2 domain corresponding to 309 and 321 (Kabat numbering).

In one embodiment of the invention a glycosylation site in Kabat position 314 of the CH2 domain is removed. It is preferred that this removal of the glycosylation site is achieved by a N314X substitution, wherein X is any amino acid excluding Q. Said substitution is preferably a N314G substitution. In a more preferred embodiment, said CH2 domain additionally comprises the following substitutions (position according to Kabat) V321C and R309C (these substitutions introduce the intra domain cysteine disulfide bridge at Kabat positions 309 and 321).

It is assumed that the preferred features of the antibody construct of the invention compared e.g. to the bispecific heteroFc antibody construct known in the art (FIG. 1B) may be inter alia related to the introduction of the above described modifications in the CH2 domain. Thus, it is preferred for the construct of the invention that the CH2 domains in the third domain of the antibody construct of the invention comprise the intra domain cysteine disulfide bridge at Kabat positions 309 and 321 and/or the glycosylation site at Kabat position 314 is removed by a N314X substitution as above, preferably by a N314G substitution.

In a further preferred embodiment of the invention the CH2 domains in the third domain of the antibody construct of the invention comprise the intra domain cysteine disulfide bridge at Kabat positions 309 and 321 and the glycosylation site at Kabat position 314 is removed by a N314G substitution. Most preferably, the polypeptide monomer of the third domain of the antibody construct of the invention has an amino acid sequence selected from the group consisting of SEQ ID NO: 17 and 18.

In one embodiment the invention provides an antibody construct, wherein:

(i) the first domain comprises two antibody variable domains and the second domain comprises two antibody variable domains;

(ii) the first domain comprises one antibody variable domain and the second domain comprises two antibody variable domains;

(iii) the first domain comprises two antibody variable domains and the second domain comprises one antibody variable domain; or (iv) the first domain comprises one antibody variable domain and the second domain comprises one antibody variable domain.

Accordingly, the first and the second domain may be binding domains comprising each two antibody variable domains such as a VH and a VL domain. Examples for such binding domains comprising two antibody variable domains where described herein above and comprise e.g. Fv fragments, scFv fragments or Fab fragments described herein above. Alternatively either one or both of those binding domains may comprise only a single variable domain. Examples for such single domain binding domains where described herein above and comprise e.g. nanobodies or single variable domain antibodies comprising merely one variable domain, which might be VHH, VH or VL, that specifically bind an antigen or epitope independently of other V regions or domains.

In a preferred embodiment of the antibody construct of the invention first and second domain are fused to the third domain via a peptide linker. Preferred peptide linker have been described herein above and are characterized by the amino acid sequence Gly-Gly-Gly-Gly-Ser, i.e. $Gly_4Ser$ (SEQ ID NO: 1), or polymers thereof, i.e. $(Gly_4Ser)x$, where x is an integer of 1 or greater (e.g. 2 or 3). A particularly preferred linker for the fusion of the first and second domain to the third domain is depicted in SEQ ID NOs: 1.

In a preferred embodiment the antibody construct of the invention is characterized to comprise in an amino to carboxyl order:

(a) the first domain;

(b) a peptide linker having an amino acid sequence selected from the group consisting of SEQ ID NOs: 1-3;

(c) the second domain;

(d) a peptide linker having an amino acid sequence selected from the group consisting of SEQ ID NO: 1, 2, 3, 9, 10, 11 and 12;

(e) the first polypeptide monomer of the third domain; (f) a peptide linker having an amino acid sequence selected from the group consisting of SEQ ID NOs: 5, 6, 7 and 8; and (g) the second polypeptide monomer of the third domain.

In one aspect of the invention the target cell surface antigen bound by the first domain is a tumor antigen, an antigen specific for an immunological disorder or a viral antigen. The term "tumor antigen" as used herein may be understood as those antigens that are presented on tumor cells. These antigens can be presented on the cell surface with an extracellular part, which is often combined with a transmembrane and cytoplasmic part of the molecule. These antigens can sometimes be presented only by tumor cells and never by the normal ones. Tumor antigens can be exclusively expressed on tumor cells or might represent a tumor specific mutation compared to normal cells. In this case, they are called tumor-specific antigens. More common are antigens that are presented by tumor cells and normal cells, and they are called tumor-associated antigens. These tumor-associated antigens can be overexpressed compared to normal cells or are accessible for antibody binding in tumor cells due to the less compact structure of the tumor tissue compared to normal tissue. Non-limiting examples of tumor antigens as used herein are CDH19, MSLN, DLL3, FLT3, EGFRvIII, CD33, CD19, CD20, and CD70.

In a preferred embodiment of the antibody construct of the invention the tumor antigen is selected from the group consisting of CDH19, MSLN, DLL3, FLT3, EGFRvIII, CD33, CD19, CD20, and CD70.

In one aspect of the invention the antibody construct comprises in an amino to carboxyl order:

(a) the first domain having an amino acid sequence selected from the group consisting of SEQ ID NOs: 52, 70, 58, 76, 88, 106, 124, 94, 112, 130, 142,160, 178, 148, 166, 184, 196, 214, 232, 202, 220, 238, 250, 266, 282, 298, 255, 271, 287, 303, 322, 338, 354, 370, 386, 402, 418, 434, 450, 466, 482, 498, 514, 530, 546, 327, 343, 359, 375, 391, 407, 423, 439, 455, 471, 487, 503, 519, 353, 551, 592, 608, 624, 640, 656, 672, 688, 704, 720, 736, 752, 768, 784, 800, 816, 832, 848, 864, 880, 896, 912, 928, 944, 960, 976, 992, 1008, 1024, 1040, 1056, 1072, 1088, 1104, 1120, 1136, 1152, 1168, 1184, 597, 613, 629, 645, 661, 677, 693, 709, 725, 741, 757, 773, 789, 805, 821, 837, 853, 869, 885, 901, 917, 933,949, 965, 981, 997, 1013, 1029, 1045, 1061, 1077, 1093, 1109, 1125, 1141, 1157, 1173, 1189, 1277, 1289, 1301, 1313, 1325, 1337, 1349, 1361, 1373, 1385, 1397, 1409, 1421, 1433, 1445;

(b) a peptide linker having an amino acid sequence selected from the group consisting of SEQ ID NOs: 1-3;

(c) the second domain having an amino acid sequence selected from the group consisting of SEQ ID NOs: SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 1460-1479, respectively, herein) or of SEQ ID NO: 15;

(d) a peptide linker having an amino acid sequence selected from the group consisting of SEQ ID NOs: 1, 2, 3, 9, 10, 11 and 12;

(e) the first polypeptide monomer of the third domain having a polypeptide sequence selected from the group consisting of SEQ ID NOs: 17-24; (f) a peptide linker having an amino acid sequence selected from the group consisting of SEQ ID NOs: 5, 6, 7 and 8; and (g) the second polypeptide monomer of the third domain having a polypeptide sequence selected from the group consisting of SEQ ID NOs: 17-24.

In line with this preferred embodiment the first and second domain, which are fused via a peptide linker to a single chain polypeptide comprise a sequence selected from the group consisting of:

(a) SEQ ID NOs: 53 and 59; CD33
(b) SEQ ID NOs: 71 and 77; EGFRvIII
(c) SEQ ID NOs:89, 107, 125, 95, 113, and 131; MSLN
(d) SEQ ID NOs:143, 161, 179, 149, 167, and 185; CDH19
(e) SEQ ID NOs:197, 215, 233, 203, 221, and 239; DLL3
(f) SEQ ID NOs:251, 267, 283, 299, 256, 272, 288, and 304; CD19
(g) SEQ ID NOs:323, 339, 355, 371, 387, 403, 419, 435, 451, 467, 483, 499, 515, 531, 547, 328, 344, 360, 376, 392, 408, 424, 440, 456, 472, 488, 504, 520, 536, and 552; FLT3
(h) SEQ ID NOs:593, 609, 625, 641, 657, 673, 689, 705, 721, 737, 753, 769, 785, 801, 817, 833, 849, 865, 881, 897, 913, 929, 945, 961, 977, 993, 1009, 1025, 1041, 1057, 1073, 1089, 1105, 1121, 1137, 1153, 1169, 1185, 598, 614, 630, 646, 662, 678, 694, 710, 726, 742, 758, 774, 790, 806, 822, 838, 854, 870, 886, 902, 918, 934, 950, 966, 982, 998, 1014, 1030, 1046, 1062, 1078, 1094, 1110, 1126, 1142, 1158, 1174, and 1190; CD70
(i) SEQ ID NO: 1268; and CD20
(j) SEQ ID NOs: 1278, 1290, 1302, 1314, 1326, 1338, 1350, 1362, 1374, 1386, 1398, 1410, 1422, 1434, 1446. CD19

In one aspect the antibody construct of the invention is characterized by having an amino acid sequence selected from the group consisting of:

(a) SEQ ID NOs: 54, 55, 60, and 61; CD33
(b) SEQ ID NOs: 72, 73, 78, and 79; EGFRvIII
(c) SEQ ID NOs: 90, 91, 96, 97, 108, 109, 114, and 115; MSLN
(d) SEQ ID NOs: 144, 145, 150, 151, 162, 163, 168, 169, 180, 181, 186, and 187; CDH19
(e) SEQ ID NOs: 198, 199, 204, 205, 216, 217, 222, 223, 234, 235, 240, and 241; DLL3 (f) SEQ ID NOs: 252, 306, 257, 307, 268, 308, 273, 309, 284, 310, 289, 311, 300, 312, 305, and 313; CD19
(g) SEQ ID NOs: 324, 554, 329, 555, 340, 556, 345, 557, 356, 558, 361, 559, 372, 560, 377, 561, 388, 562, 393, 563, 404, 564, 409, 565, 420, 566, 425, 567, 436, 568, 441, 569, 452, 570, 457, 571, 468, 572, 473, 573, 484, 574, 489, 575, 500, 576, 505, 577, 516, 578, 521, 579, 532, 580, 537, 581, 548, 582, 553, and 583; FLT3
(h) SEQ ID NOs: 594, 610, 626, 642, 658, 674, 690, 706, 722, 738, 754, 77, 786, 802, 818, 834, 850, 866, 882, 898, 914, 930, 946, 962, 978, 994, 1010, 1026, 1042, 1058, 1074, 1090, 1106, 1122, 1138, 1154, 1170, 1186, 599, 615, 631, 647, 663, 679, 695, 711, 727, 743, 759, 775, 791, 807, 823, 839, 855, 871, 887, 903, 919, 935, 951, 967, 983, 999, 1015, 1031, 1047, 1063, 1079, 1095, 1111, 1127, 1143, 1159, 1175, 1191, and 1192-1267; CD70
(i) SEQ ID NO: 43; CD20
(j) SEQ ID Nos: 1279, 1280, 1291, 1292, 1303, 1304, 1315, 1316, 1327, 1328, 1339, 1340, 1351, 1352, 1363, 1364, 1375, 1376, 1387, 1388, 1399, 1400, 1411, 1412, 1423, 1424, 1435, 1436, 1447, 1448. CD19

The invention further provides a polynucleotide/nucleic acid molecule encoding an antibody construct of the invention. A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention. A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding side. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding side is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density.

Moreover, the invention provides a host cell transformed or transfected with the polynucleotide/nucleic acid molecule or with the vector of the invention. As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as *Neurospora, Penicillium, Tolypocladium*, and *Aspergillus* hosts such as *A. nidulans* and *A. niger.*

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, petunia, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J.T. Baker, Phillipsburg, NJ) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention. It is preferred for the pharmaceutical composition of the invention that the homogeneity of the antibody construct is ≤80%, more preferably ≤81%, ≤82%, ≤83%, ≤84%, or ≤85%, further preferably ≤86%, ≤87%, ≤88%, ≤89%, or ≤90%, still further preferably, ≤91%, ≤92%, ≤93%, ≤94%, or ≤95% and most preferably ≤96%, ≤97%, ≤98% or ≤99%.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

amino acids such as glycine, alanine, glutamine, asparagine, threonine, proline, 2-phenylalanine, including charged amino acids, preferably lysine, lysine acetate, arginine, glutamate and/or histidine antimicrobials such as antibacterial and antifungal agents antioxidants such as ascorbic acid, methionine, sodium sulfite or sodium hydrogen-sulfite;

buffers, buffer systems and buffering agents which are used to maintain the composition at physiological pH or at a slightly lower pH; examples of buffers are borate, bicarbonate, Tris-HCl, citrates, phosphates or other organic acids, succinate, phosphate, and histidine; for example Tris buffer of about pH 7.0-8.5;

non-aqueous solvents such as propylene glycol, polyethylene glycol, vegetable oils such as olive oil, and injectable organic esters such as ethyl oleate;

aqueous carriers including water, alcoholic/aqueous solutions, emulsions or suspensions, including saline and buffered media;

biodegradable polymers such as polyesters;

bulking agents such as mannitol or glycine;

chelating agents such as ethylenediamine tetraacetic acid (EDTA);

isotonic and absorption delaying agents;

complexing agents such as caffeine, polyvinylpyrrolidone, beta-cyclodextrin or hydroxypropyl-beta-cyclodextrin)

fillers;

monosaccharides; disaccharides; and other carbohydrates (such as glucose, mannose or dextrins); carbohydrates may be non-reducing sugars, preferably trehalose, sucrose, octasulfate, sorbitol or xylitol;

(low molecular weight) proteins, polypeptides or proteinaceous carriers such as human or bovine serum albumin, gelatin or immunoglobulins, preferably of human origin;

coloring and flavouring agents;

sulfur containing reducing agents, such as glutathione, thioctic acid, sodium thioglycolate, thioglycerol, [alpha]-monothioglycerol, and sodium thio sulfate diluting agents;

emulsifying agents;

hydrophilic polymers such as polyvinylpyrrolidone)

salt-forming counter-ions such as sodium;

preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);

metal complexes such as Zn-protein complexes;

solvents and co-solvents (such as glycerin, propylene glycol or polyethylene glycol);

sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;

suspending agents;

surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;

stability enhancing agents such as sucrose or sorbitol;

tonicity enhancing agents such as alkali metal halides, preferably sodium or potassium chloride, mannitol sorbitol;

parenteral delivery vehicles including sodium chloride solution, Ringer's dextrose, dextrose and sodium chloride, lactated Ringer's, or fixed oils;

intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention might comprise, in addition to the polypeptide of the invention defined herein, further biologically active agents, depending on the intended use of the composition. Such agents might be drugs acting on the gastrointestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized-dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above. It is an envisaged characteristic of the antibody constructs of the present invention provided with the specific FC modality that they comprise, for example, differences in pharmacokinetic behavior. A half-life extended targeting antibody construct according to the present invention preferably shows a surprisingly increased residence time in vivo in comparison to "canonical" non-HLE versions of said antibody construct.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

In a preferred aspect of the invention the pharmaceutical composition is stable for at least four weeks at about −20° C. As apparent from the appended examples the quality of an antibody construct of the invention vs. the quality of corresponding state of the art antibody constructs may be tested using different systems. Those tests are understood to be in line with the "*ICH Harmonised Tripartite Guideline: Stability Testing of Biotechnological/Biological Products Q5C and Specifications: Test procedures and Acceptance Criteria for Biotech Biotechnological/Biological Products Q6B*" and, thus are elected to provide a stability-indicating profile that provides certainty that changes in the identity, purity and potency of the product are detected. It is well accepted that the term purity is a relative term. Due to the effect of glycosylation, deamidation, or other heterogeneities, the absolute purity of a biotechnological/biological product should be typically assessed by more than one method and the purity value derived is method-dependent. For the purpose of stability testing, tests for purity should focus on methods for determination of degradation products.

For the assessment of the quality of a pharmaceutical composition comprising an antibody construct of the invention may be analyzed e.g. by analyzing the content of soluble aggregates in a solution (HMWS per size exclusion). It is preferred that stability for at least four weeks at about −20° C. is characterized by a content of less than 1.5% HMWS, preferably by less than 1% HMWS.

A preferred formulation for the antibody construct as a pharmaceutical composition may e.g. comprise the components of a formulation as described below:

Formulation:

potassium phosphate, L-arginine hydrochloride, trehalose dihydrate, polysorbate 80 at pH 6.0

Other examples for the assessment of the stability of an antibody construct of the invention in form of a pharmaceutical composition are provided in the appended examples 4-12. In those examples embodiments of antibody constructs of the invention are tested with respect to different stress conditions in different pharmaceutical formulations and the results compared with other half-life extending (HLE) formats of bispecific T cell engaging antibody construct known from the art. In general, it is envisaged that antibody constructs provided with the specific FC modality according to the present invention are typically more stable over a broad range of stress conditions such as temperature and light stress, both compared to antibody constructs provided with different HLE formats and without any HLE format (e.g. "canonical" antibody constructs). Said temperature stability may relate both to decreased (below room temperature including freezing) and increased (above room temperature including temperatures up to or above body temperature) temperature. As the person skilled in the art will acknowledge, such improved stability with regard to stress, which is hardly avoidable in clinical practice, makes the antibody construct safer because less degradation products will occur in clinical practice. In consequence, said increased stability means increased safety.

One embodiment provides the antibody construct of the invention or the antibody construct produced according to the process of the invention for use in the prevention, treatment or amelioration of a proliferative disease, a tumorous disease, a viral disease or an immunological disorder.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a tumor or cancer or a metastatic cancer as specified herein below, by the administration of an antibody construct according to the invention to a subject in need thereof. Such an improvement may also be seen as a slowing or stopping of the progression of the tumor or cancer or metastatic cancer of the patient. The term "prevention" as used herein means the avoidance of the occurrence or re-occurrence of a patient having a tumor or cancer or a metastatic cancer as specified herein below, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metastatic cancer" encompasses metastases to other tissues or organs than the one of the original tumor. Lymphomas and leukemias are lymphoid neoplasms. For the purposes of the present invention, they are also encompassed by the terms "tumor" or "cancer".

The term "viral disease" describes diseases, which are the result of a viral infection of a subject.

The term "immunological disorder" as used herein describes in line with the common definition of this term immunological disorders such as autoimmune diseases, hypersensitivities, immune deficiencies.

In one embodiment the invention provides a method for the treatment or amelioration of a proliferative disease, a tumorous disease, a viral disease or an immunological disorder, comprising the step of administering to a subject in need thereof the antibody construct of the invention, or produced according to the process of the invention.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, opthalmic, auricular/aural, vaginal, mucosal);

enteral routes (such as oral, gastrointestinal, sublingual, sublabial, buccal, rectal); and parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 μg/kg to up to about 30 mg/kg or more, depending on the factors mentioned above. In specific embodiments, the dosage may range from 1.0 μg/kg up to about 20 mg/kg, optionally from 10 μg/kg up to about 10 mg/kg or from 100 μg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating target cell antigen-expressing tumors, a therapeutically effective amount of the antibody construct of the invention, e.g. an anti-target cell antigen/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Finally, the invention provides a kit comprising an antibody construct of the invention or produced according to the process of the invention, a pharmaceutical composition of the invention, a polynucleotide of the invention, a vector of the invention and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

It must be noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within 20%, preferably within 10%, and more preferably within 5% of a given value or range. It includes, however, also the concrete number, e.g., about 20 includes 20.

The term "less than" or "greater than" includes the concrete number. For example, less than 20 means less than or equal to. Similarly, more than or greater than means more than or equal to, or greater than or equal to, respectively.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

It should be understood that this invention is not limited to the particular methodology, protocols, material, reagents, and substances, etc., described herein and as such can vary. The terminology used herein is for the purpose of describing particular embodiments only, and is not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

A better understanding of the present invention and of its advantages will be obtained from the following examples, offered for illustrative purposes only. The examples are not intended to limit the scope of the present invention in any way.

Example 1: BiTE® Induced CD69 Expression on T Cells in Absence of Target Cells Isolated PBMC from healthy human donors were cultured with increasing CDH19/CD3 or MSLN/CD3 HLE bispecific antibody constructs for 48 h. The expression of the activation marker CD69 on T cells was determined by immunostaining and flow cytometry and antigen specific conjugates mAb.

Target-independent T cell activation in terms of CD69 upregulation was observed for all anti-CDH 19 constructs but was most pronounced for heteroFc and crossbody molecules. Upregulation of CD69 by antiCDH19-scFc occurred at higher concentrations and the amplitude was in part lower compared to the other two Fc-based constructs.

For the anti-MSLN almost no target-independent T cell activation was observed for the scFc-containing molecule, while the heteroFc construct induced a strong upregulation of CD69 on the cell surface T cells in the absence of target cells.

Target-independent T cell activation induced by BiTE® constructs containing a single chain-Fc, or hetero-Fc fusion at the C-terminus was evaluated for the following constructs: BiTE® constructs (serial dilutions: 0.1 pM-2 μM)

a. MSLN scFc; 1.14 mg/mL;

b. MSLN Hetero Fc; 1.02 mg/

Human PBMC effector cells (3 donors; #065, #823, #836 (scFc) #401, #415, #433 (heteroFc); #590, #595, 598, #605 (X-body)).

48 h incubation time.

Figure 2A:
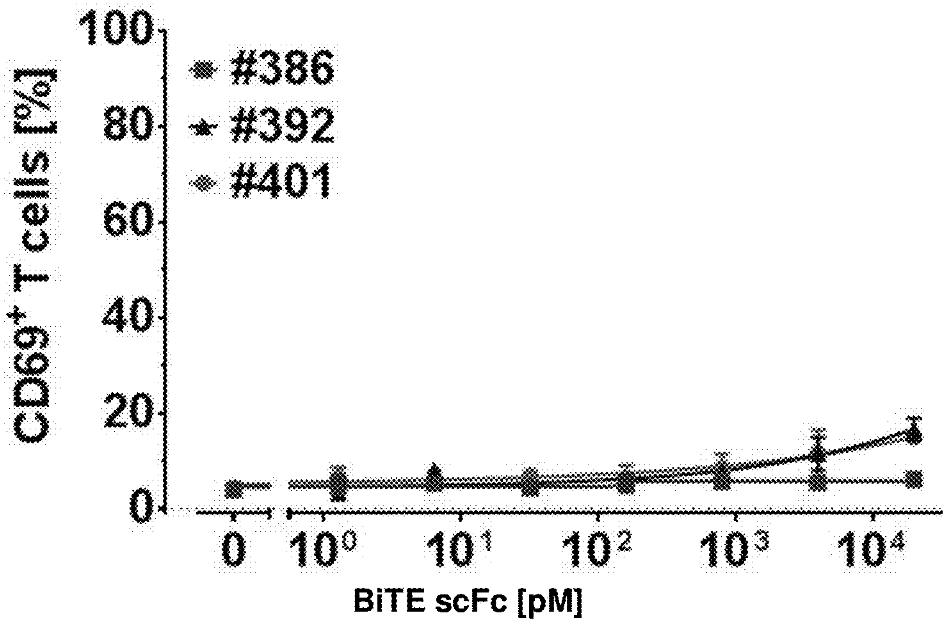
FIGS. 2A-2B: Evaluation of Target-independent T Cell Activation by Mesothelin (MS) HLE BiTE® antibody constructs.
Figure 2B:
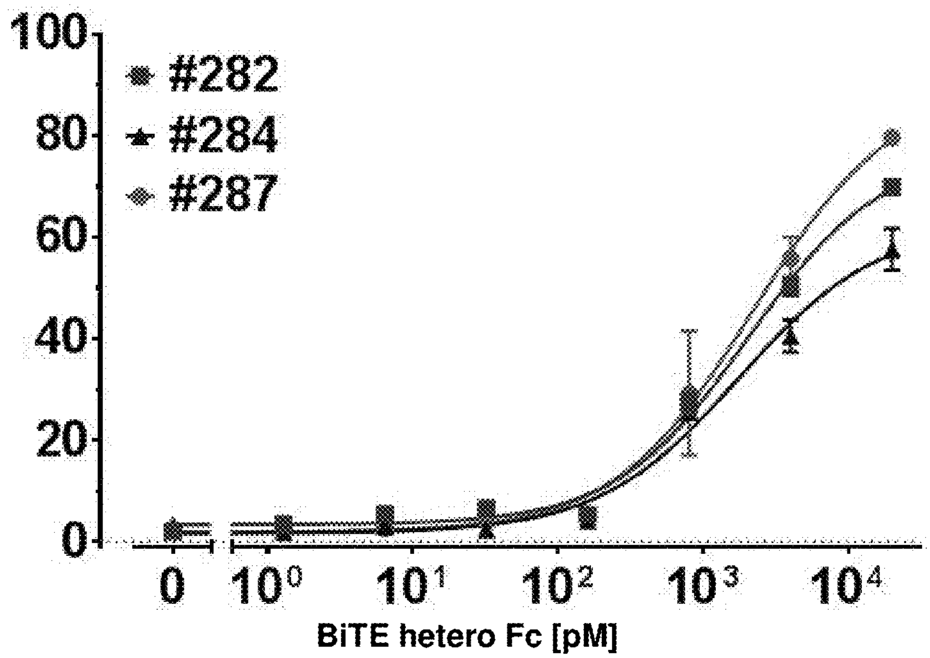

Determination of CD69 expression on CD4+ and CD8+ T cells with flow cytometer and antigen-specific conjugates mAb. Results see FIGS. 2A-2B.

Target-independent T cell activation induced by BiTE® antibody constructs containing a single chain-Fc, hetero-Fc or crossbody fusion at the C-terminus was evaluated for the following constructs:

BiTE® antibody constructs (serial dilutions: 0.1 pM-2 μM)

c. CDH19 scFc; 245.3 μg/mL ( d. CDH-19 Hetero Fc; 1 mg/mL e. CDH19 Xbody; 6.3 mg/mL Human PBMC effector cells (3 to 4 donors; #386, #392, #401 (scFc) #282, #284, #287 (heteroFc)).

48 h incubation time.

Figure 3A:
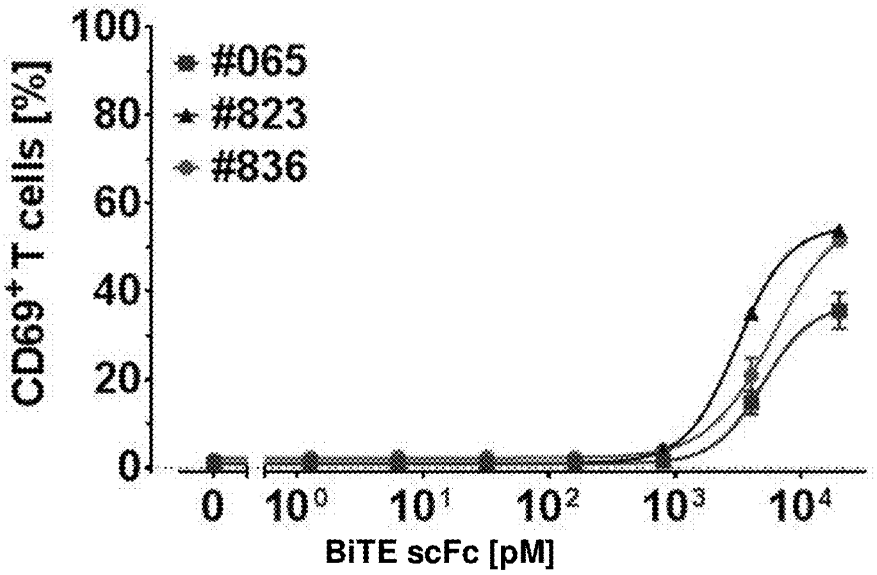
FIGS. 3A-3AB: Evaluation of Target-independent T Cell Activation by HLE BiTE® antibody constructs.
Figure 3B:
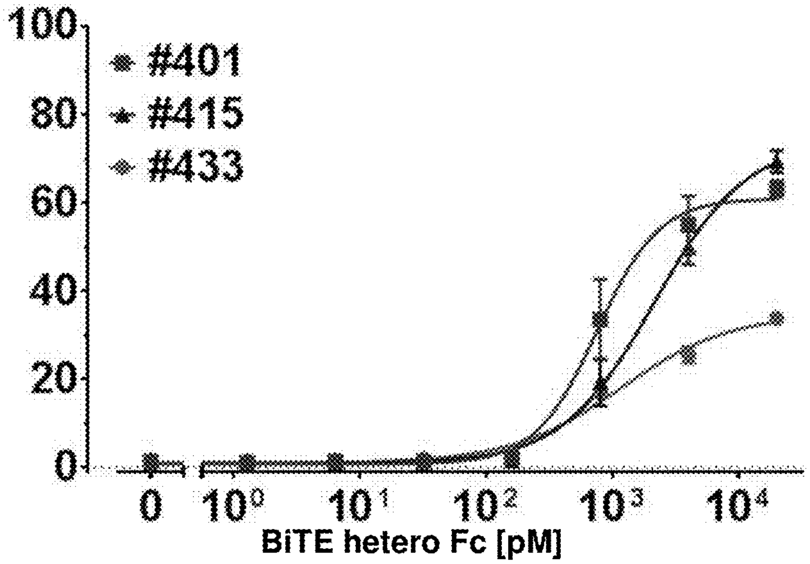
FIG. 3B—CDH19 Hetero-Fc antibody construct in 48 h activation assay with human PBMC and $CD14^+$/$CD33^+$ cell depleted PBMC (3×); HLE BiTE® serial dilutions (start 20 nM; 1:5, 7x+blank); FACS measurement of CD69 and CD25 [not shown] expression on $CD4^+$, $CD8^+$ T cells.
Figure 3C:
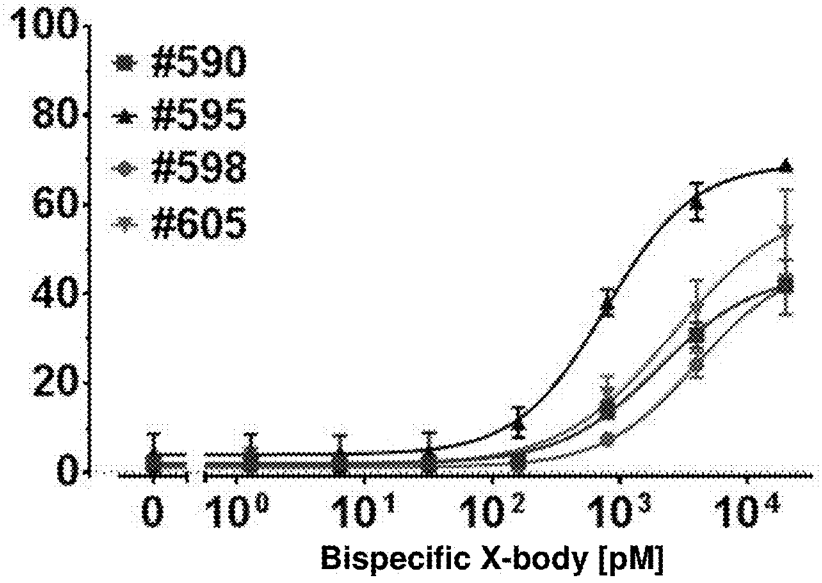
FIG. 3C—CDH19 X-body construct in 48 h activation assay with human PBMC and $CD14^+$/$CD33^+$ cell depleted PBMC (3×); HLE BiTE® serial dilutions (start 20 nM; 1:5, 7x+blank); FACS measurement of CD69 and CD25 [not shown] expression on $CD4^+$, $CD8^+$ T cells.
Figure 3D:
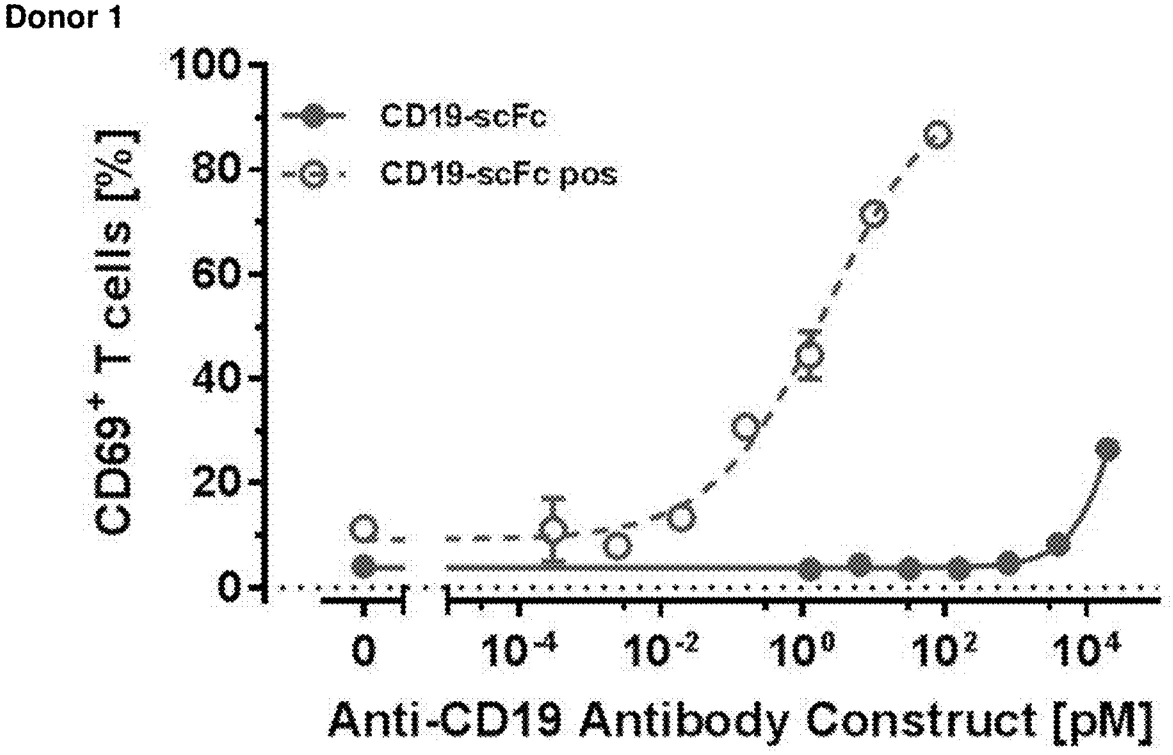
Figure 3E:
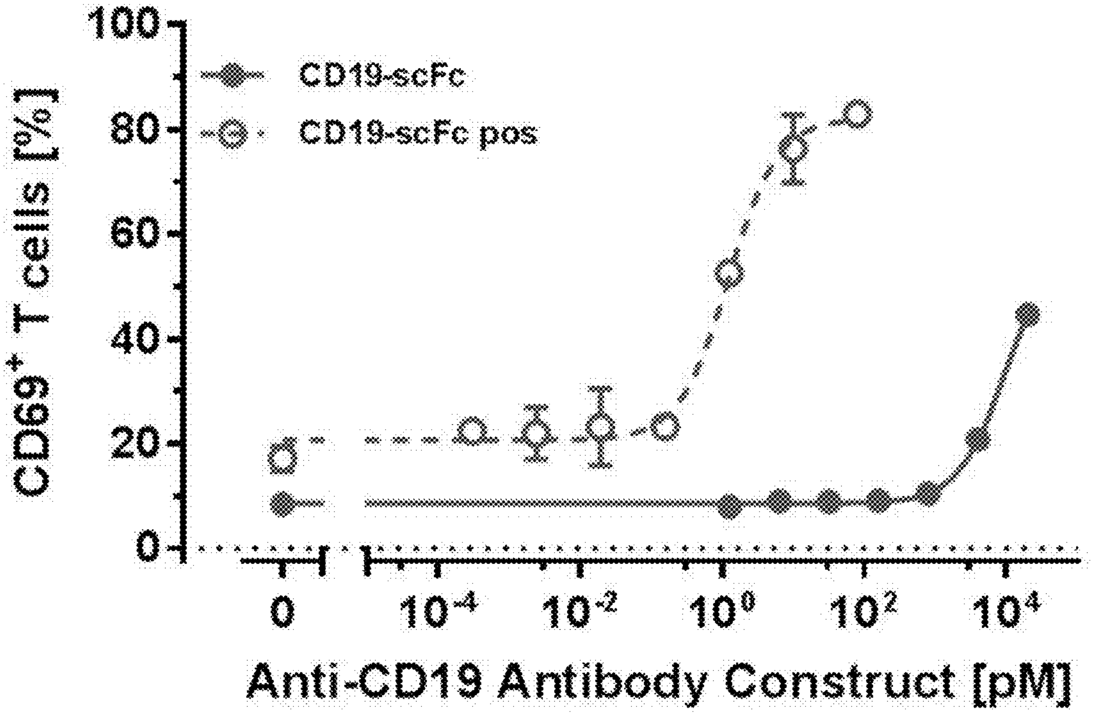
Figure 3F:
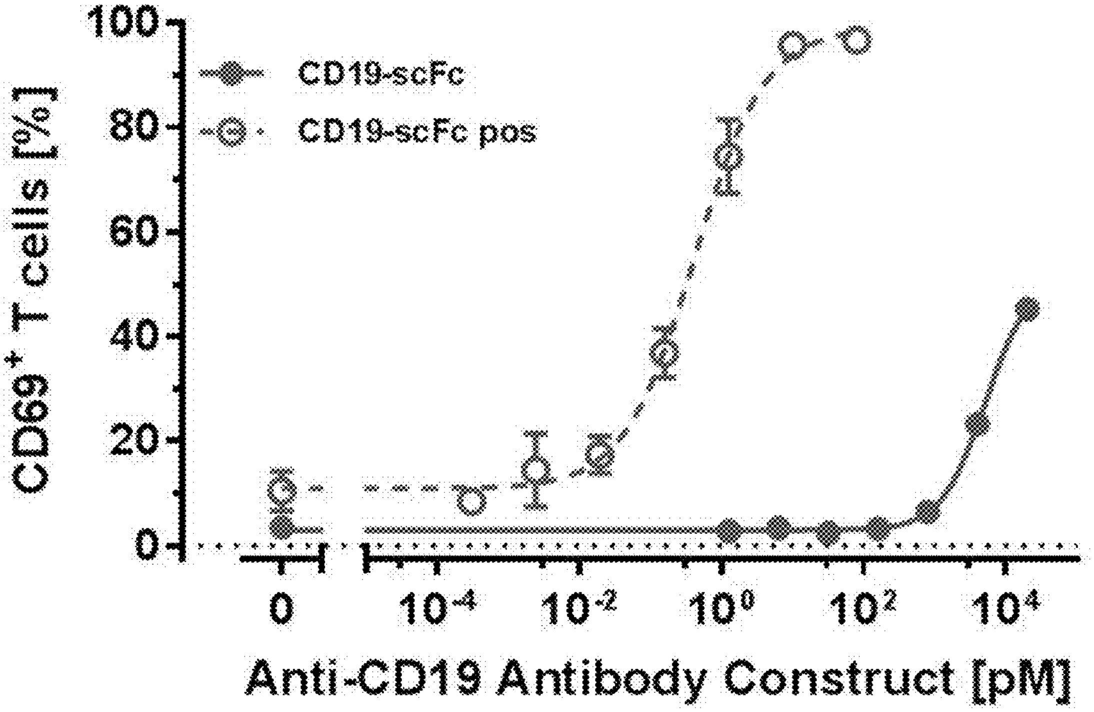
Figure 3G:
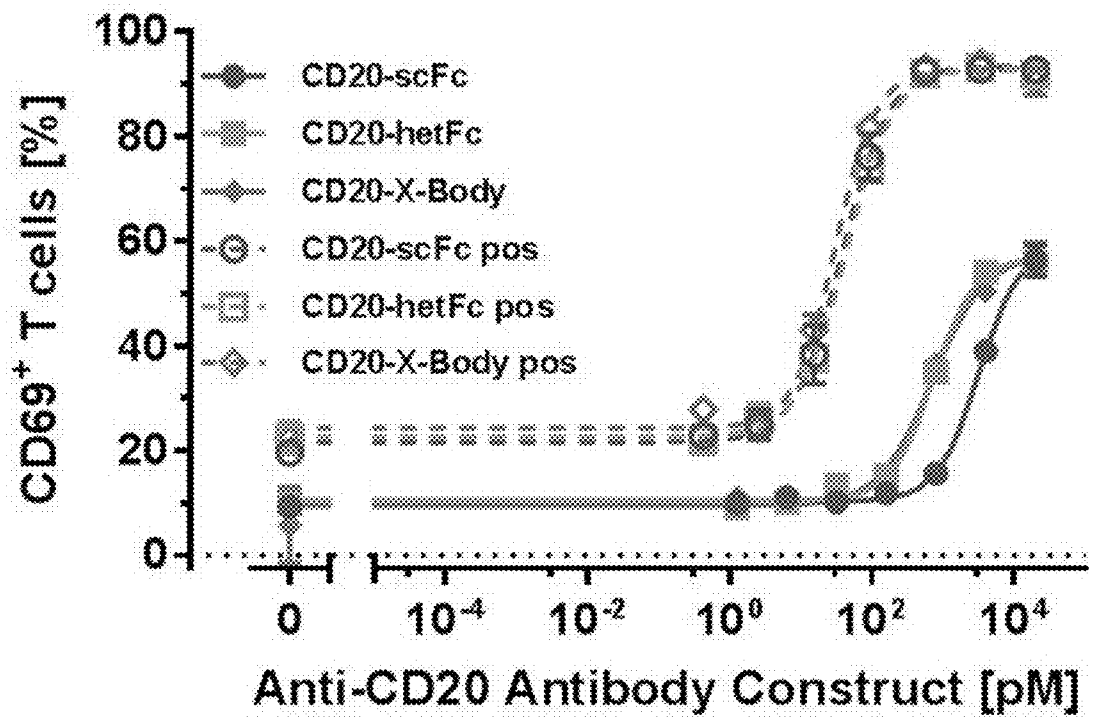
Figure 3H:
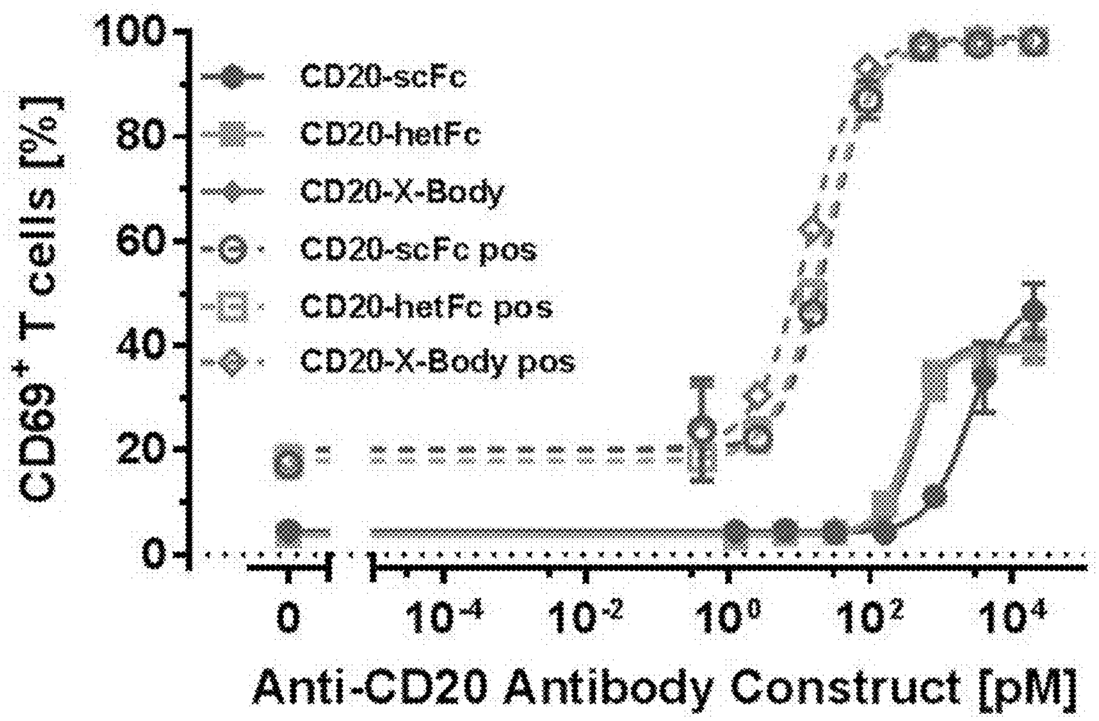
Figure 3I:
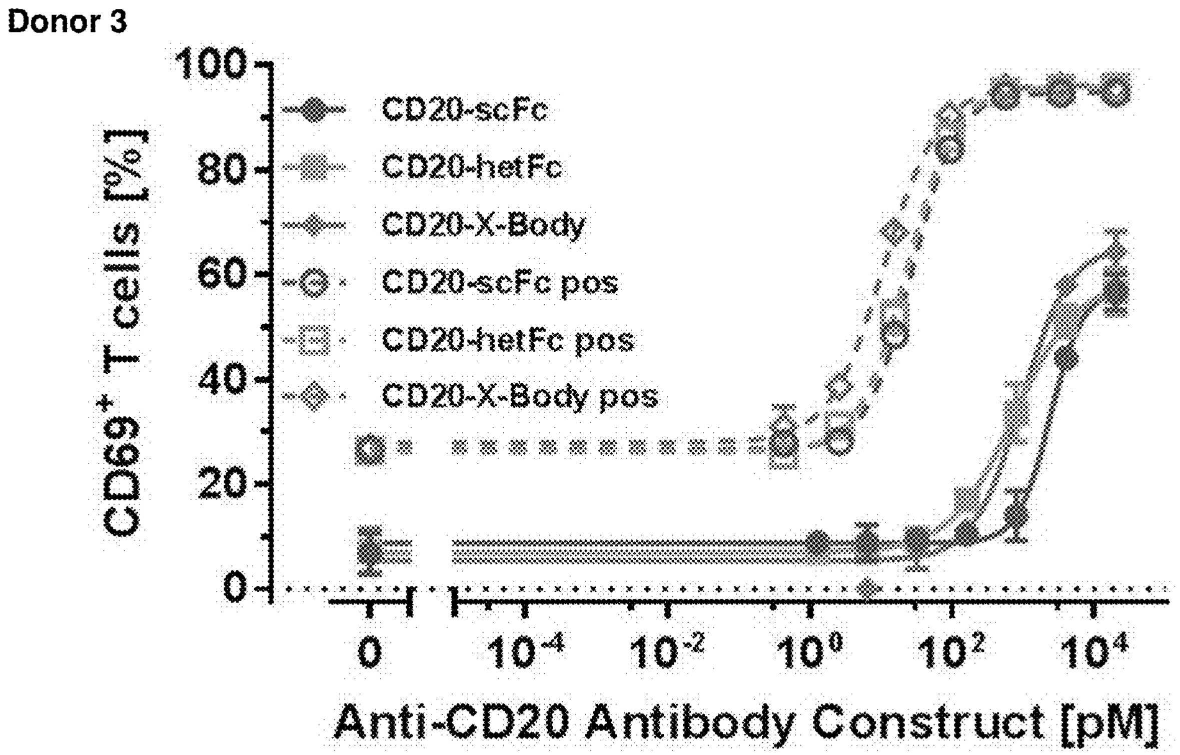
Figure 3J:
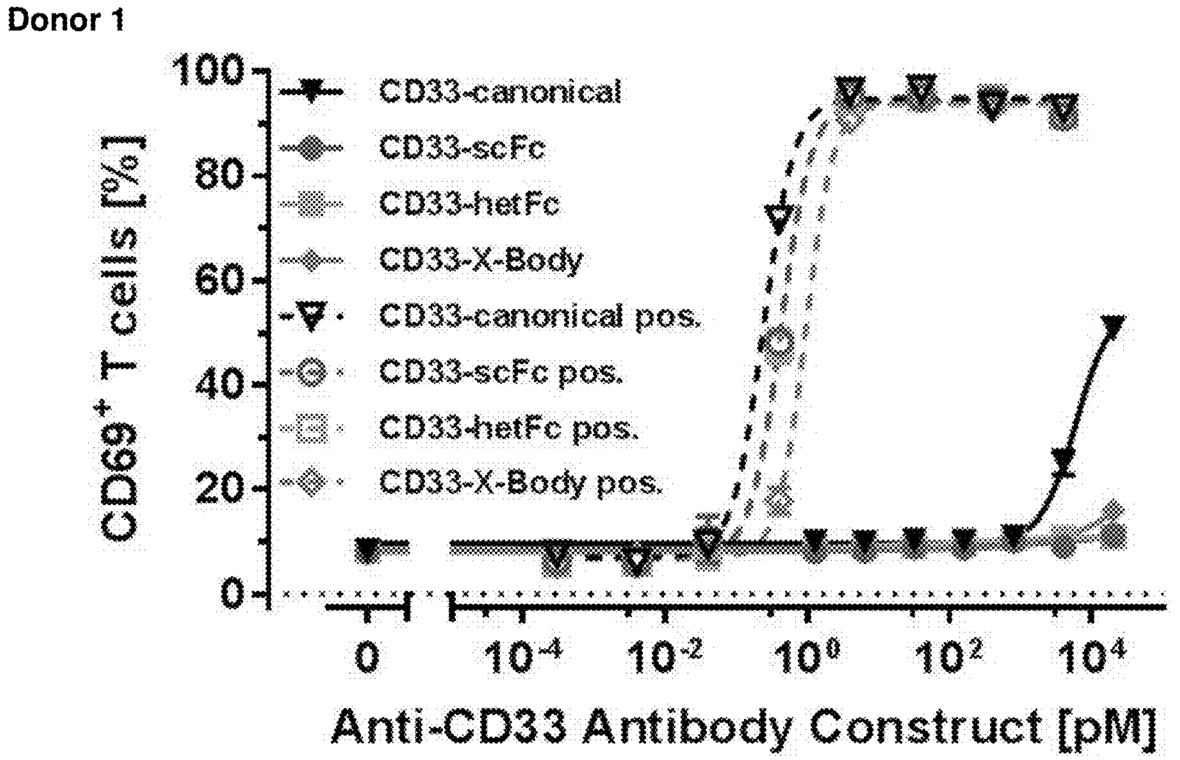
Figure 3K:
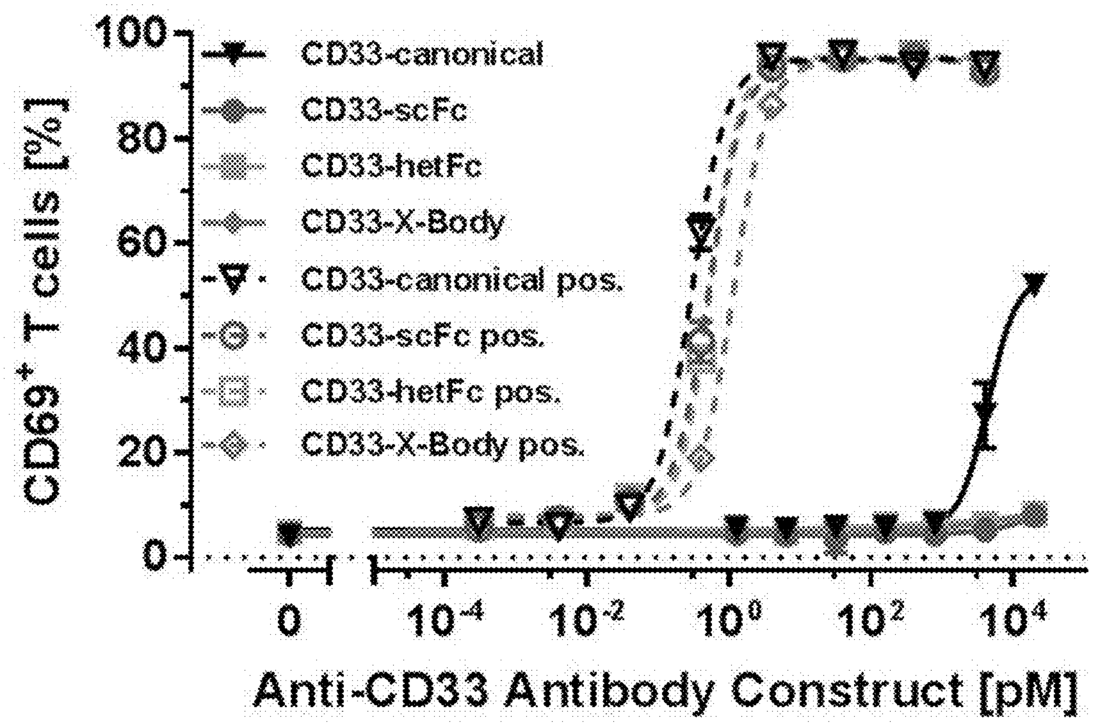
Figure 3L:
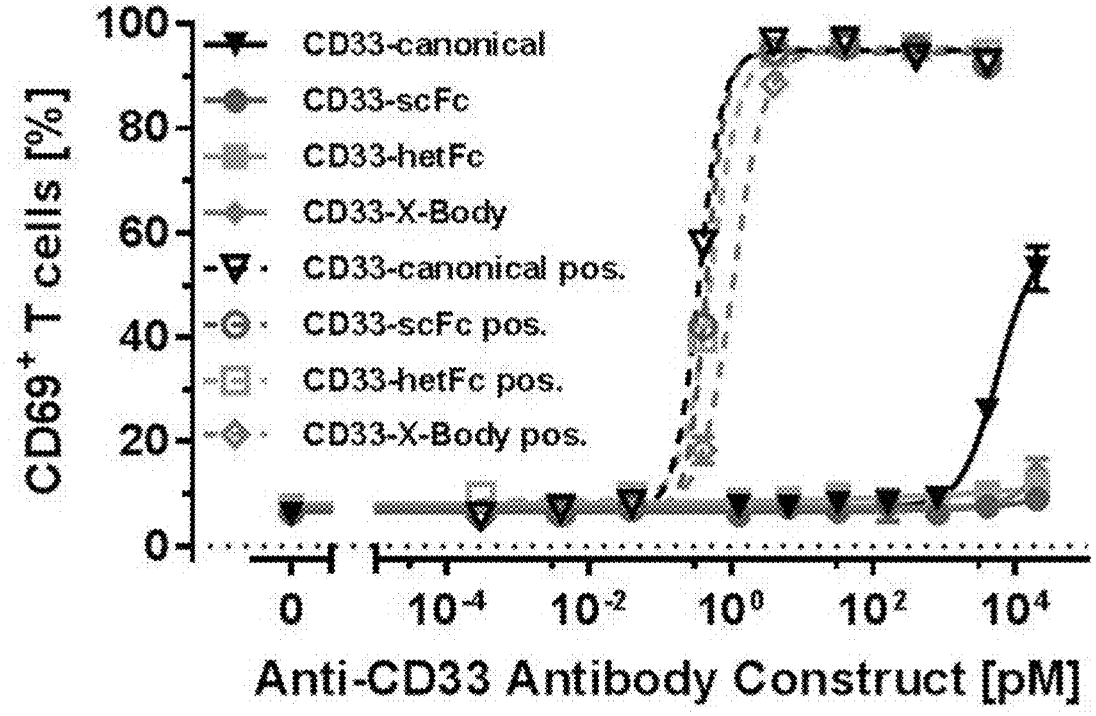
Figure 3M:
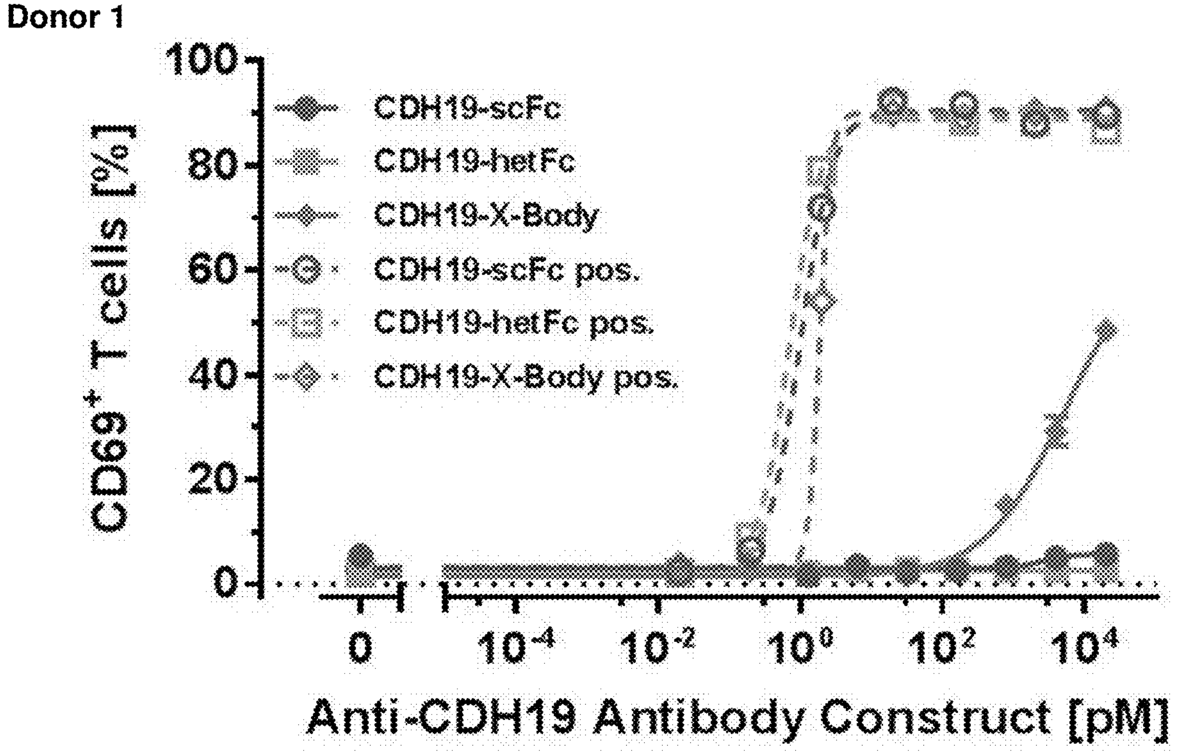
Figure 3N:
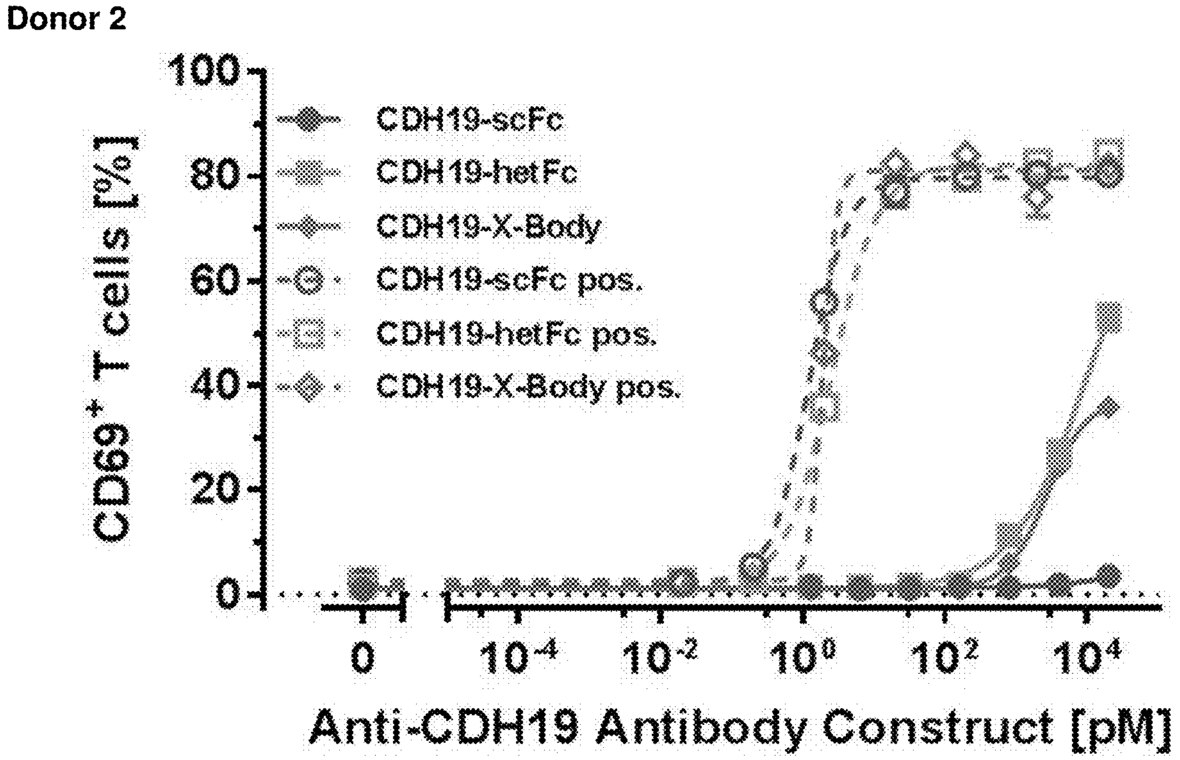
Figure 3O:
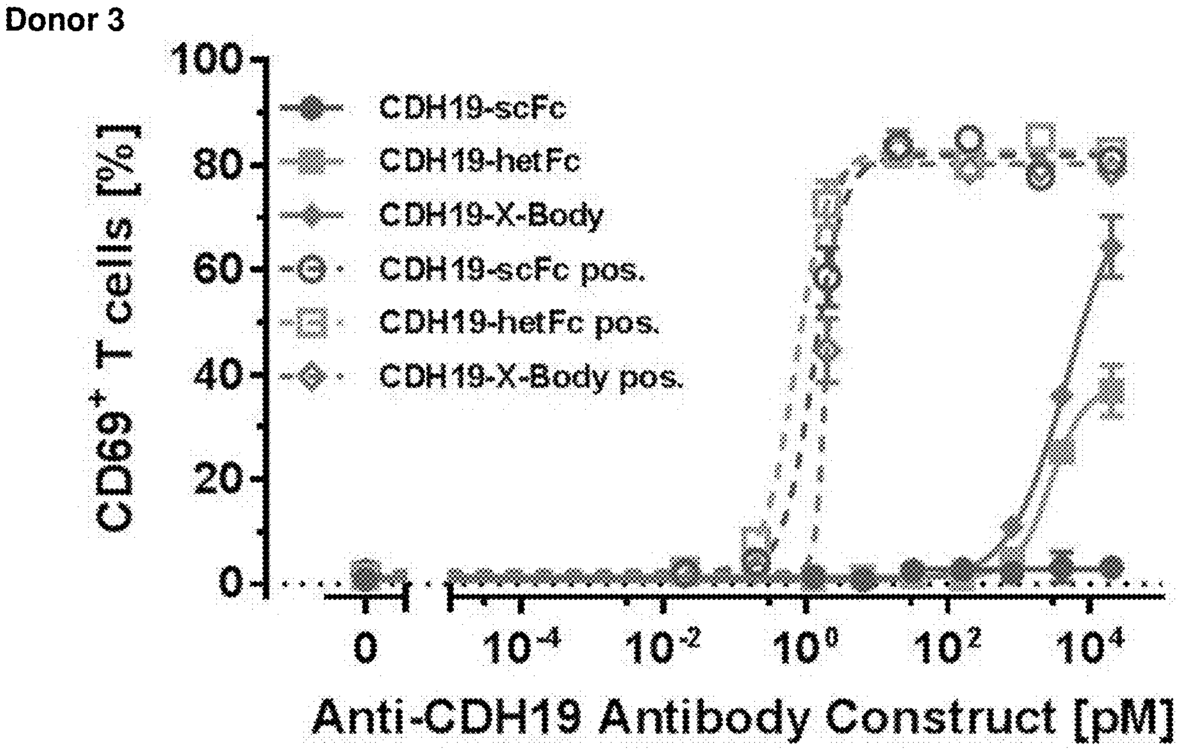
Figure 3P:
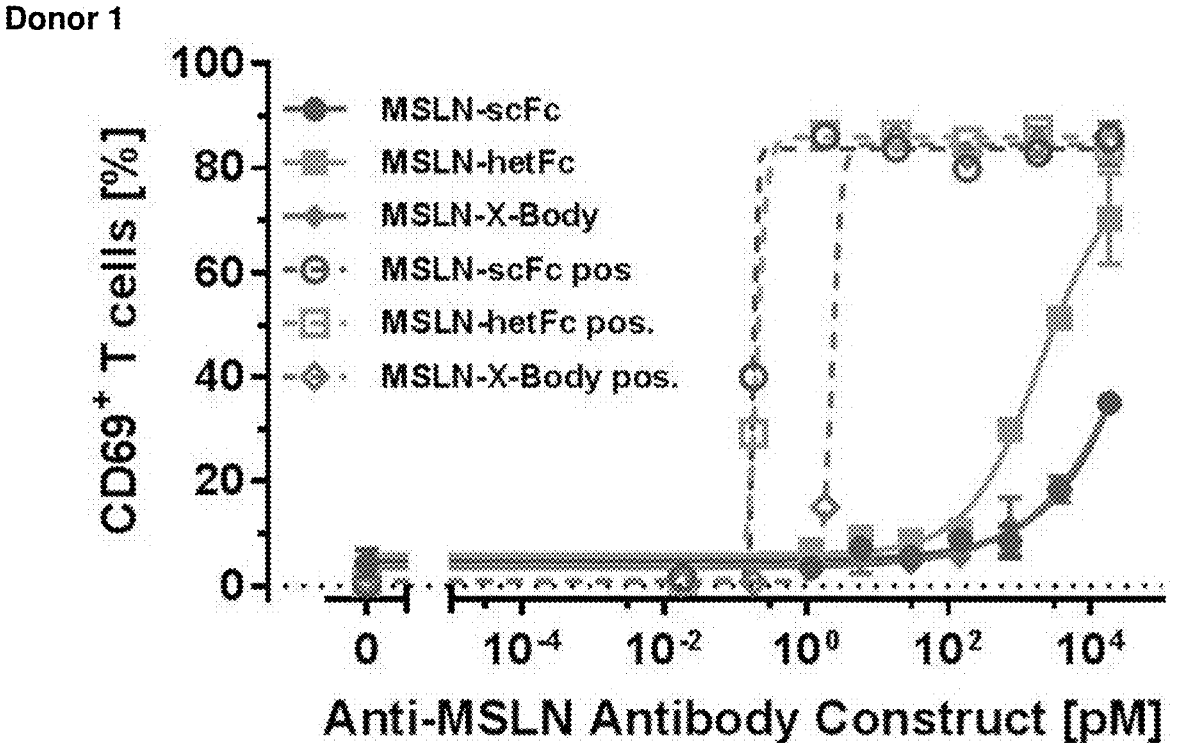
Figure 3Q:
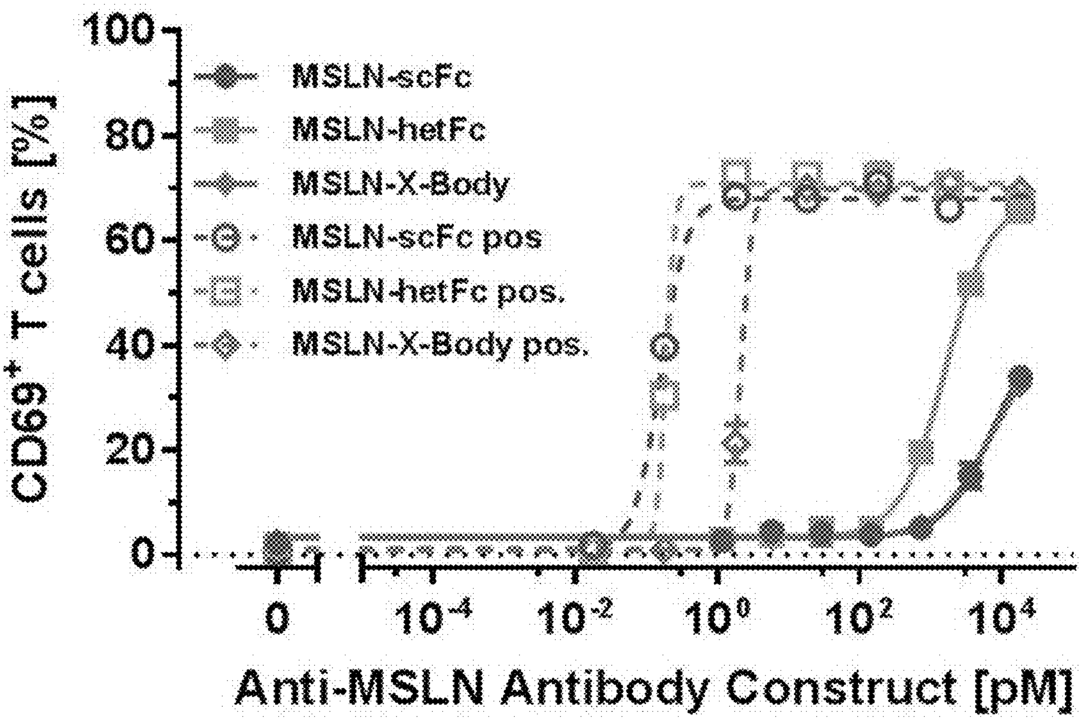
Figure 3R:
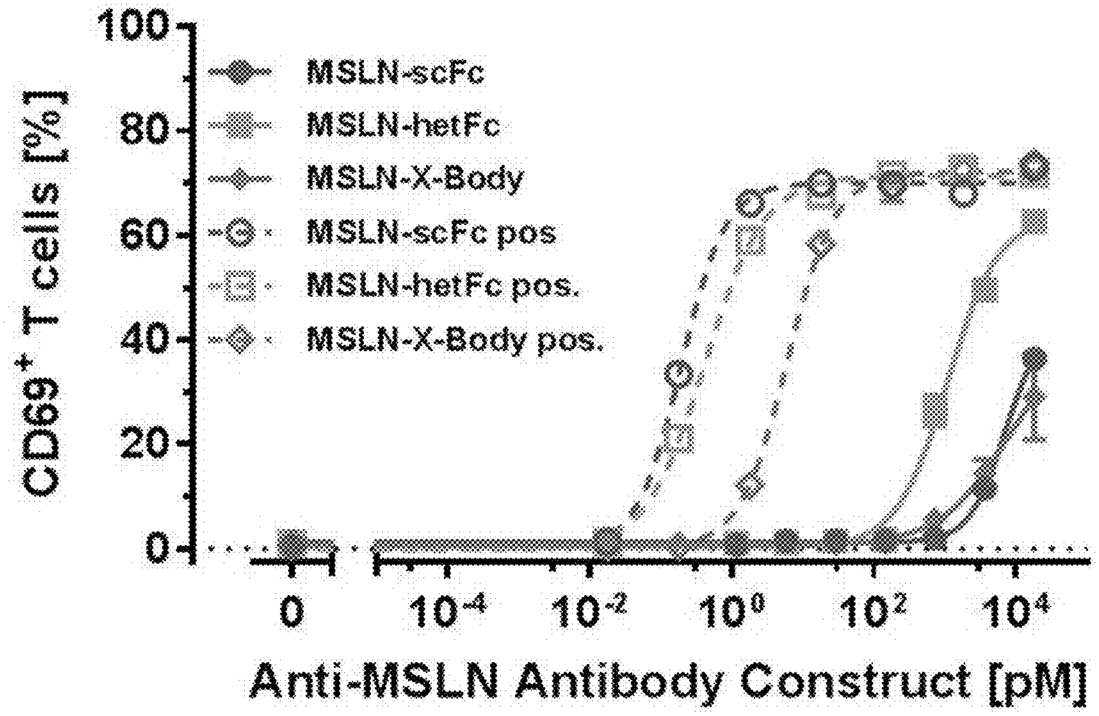
Figure 3S:
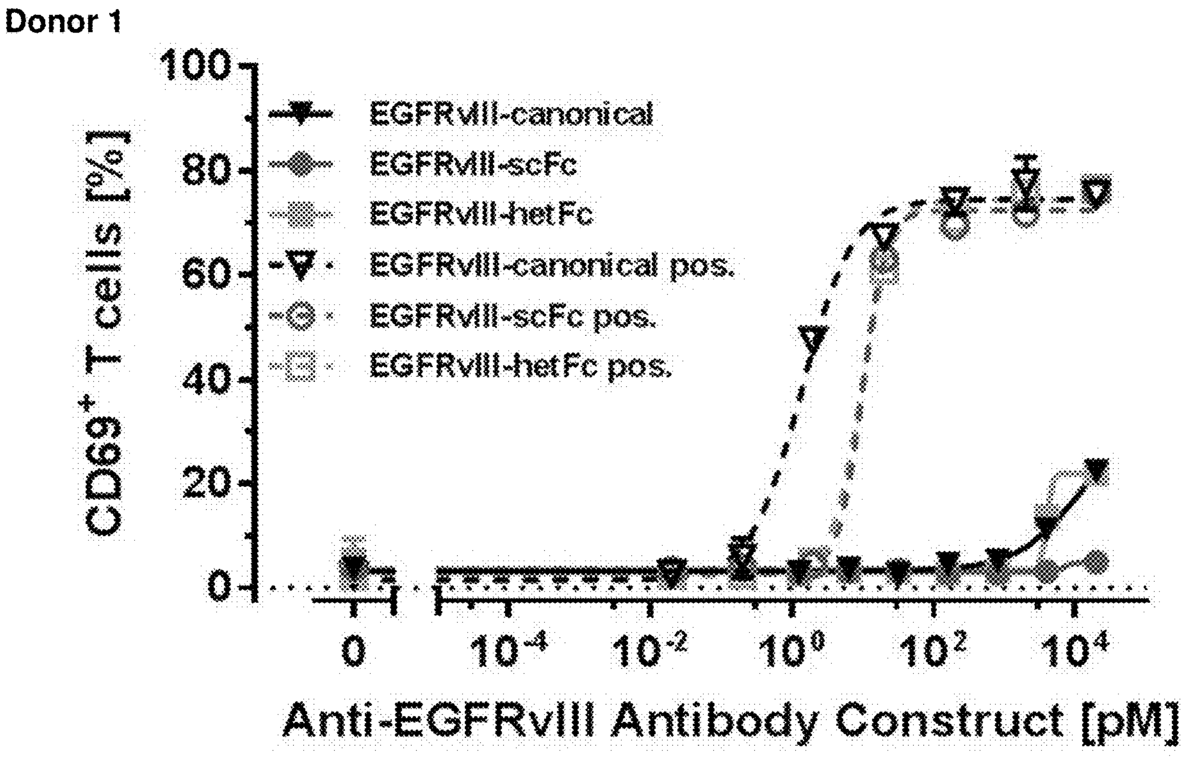
Figure 3T:
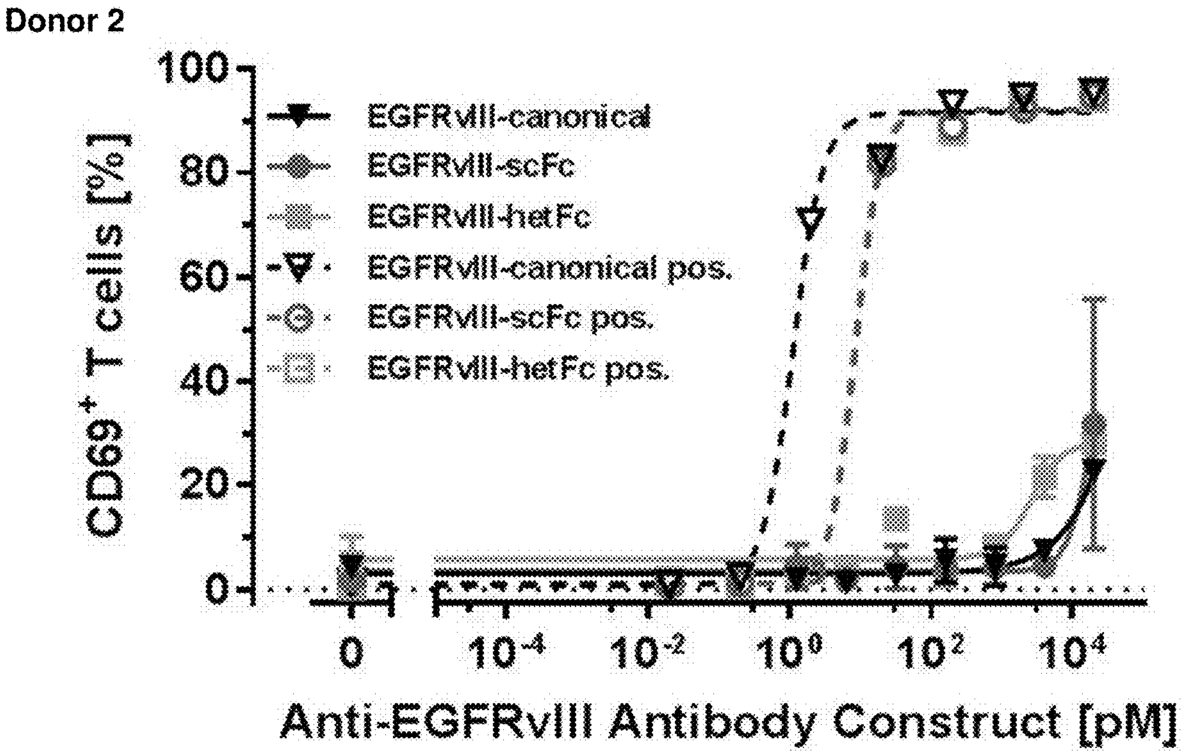
Figure 3U:
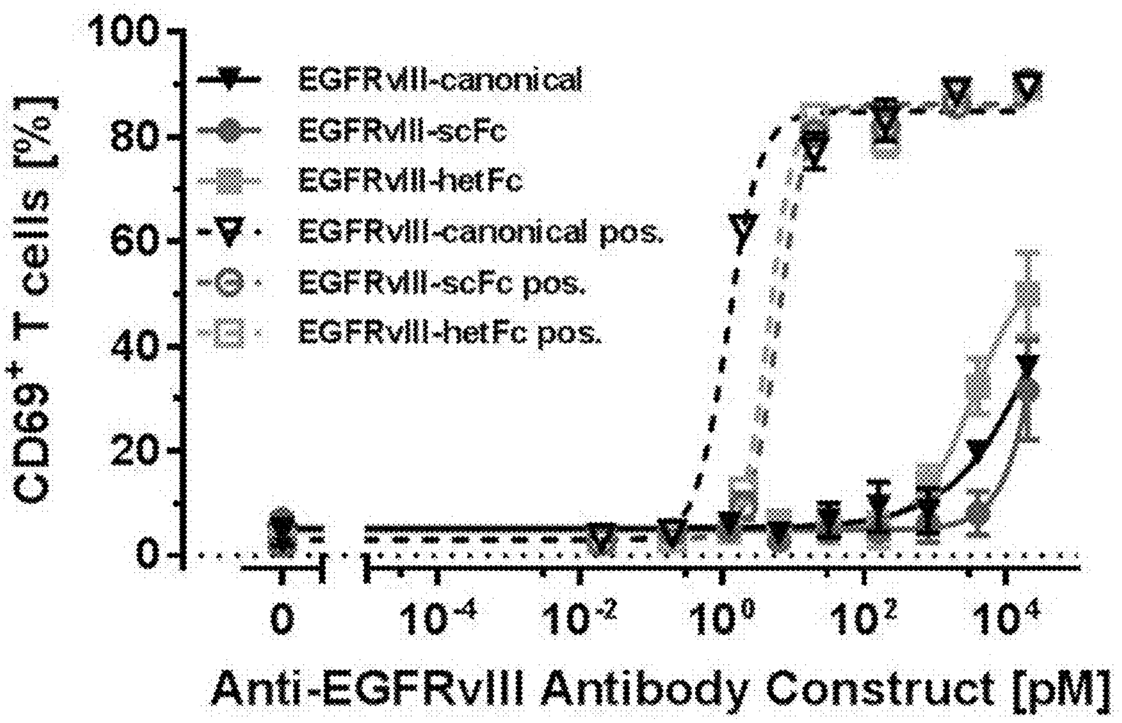
Figure 3V:
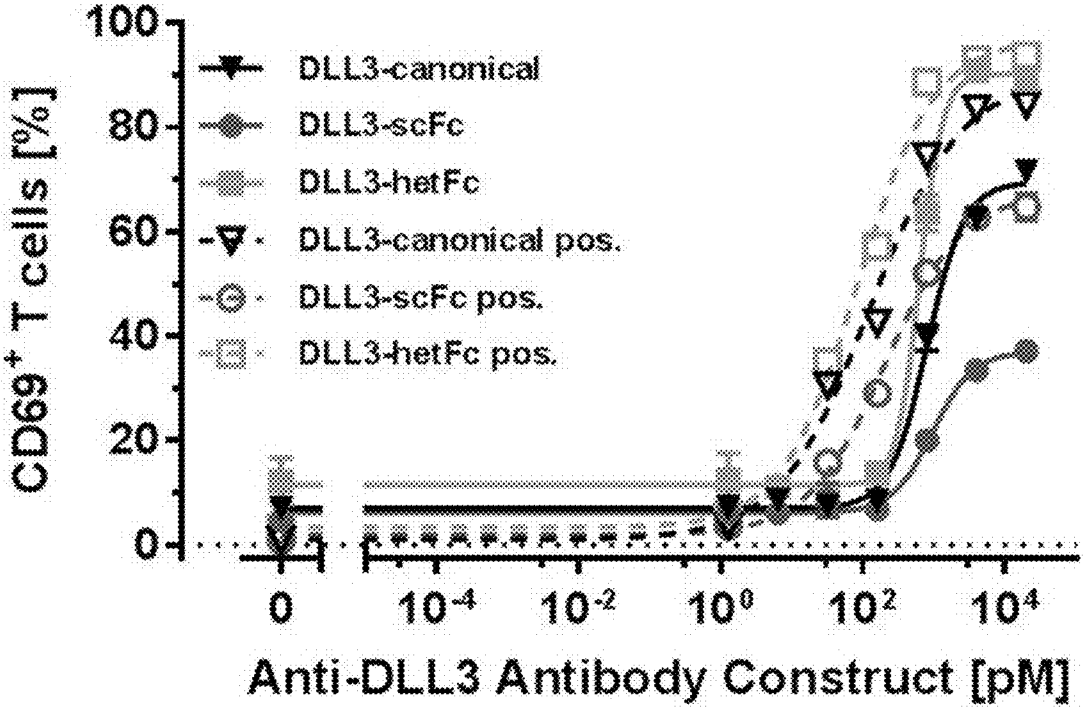
Figure 3W:
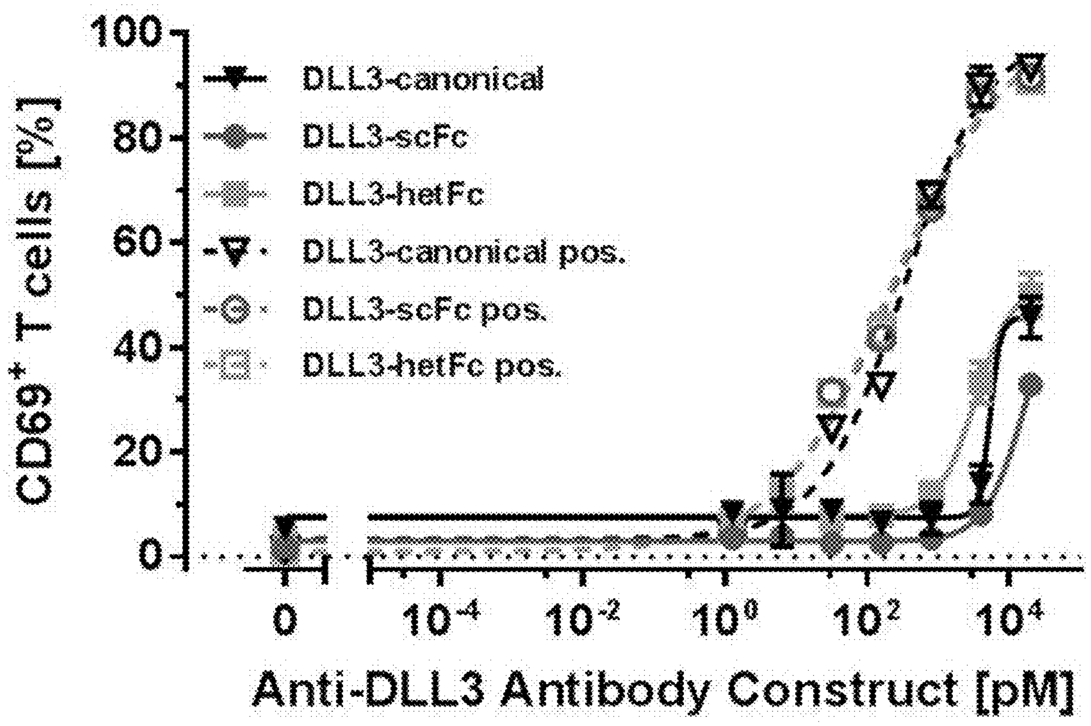
Figure 3X:
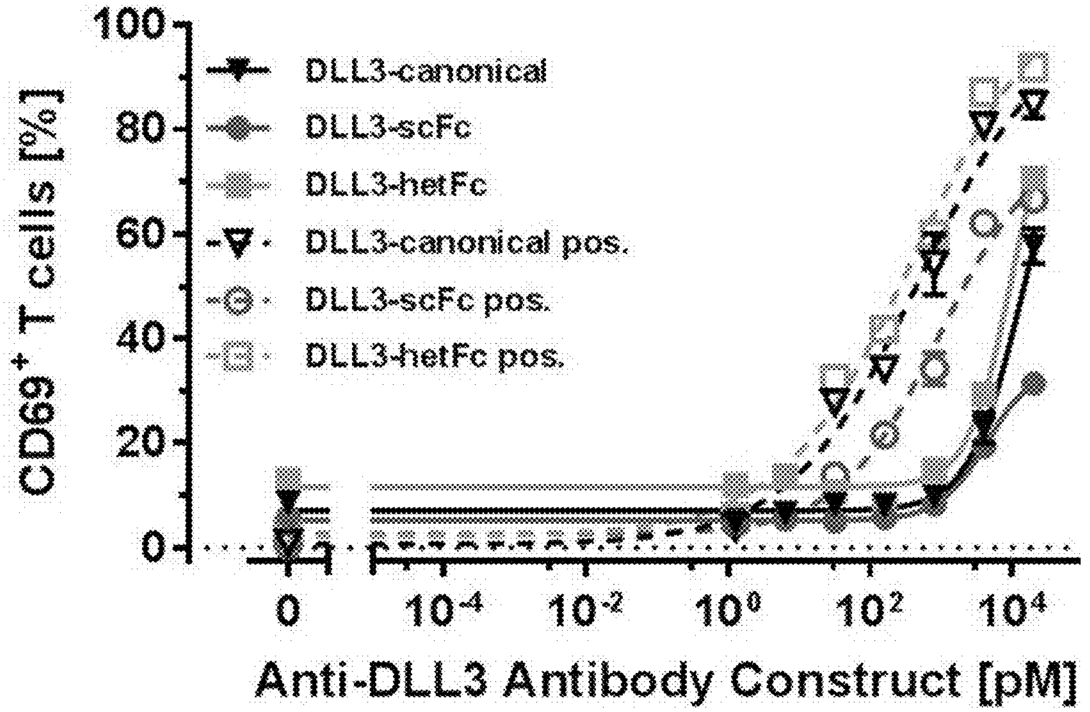
Figure 3Y:
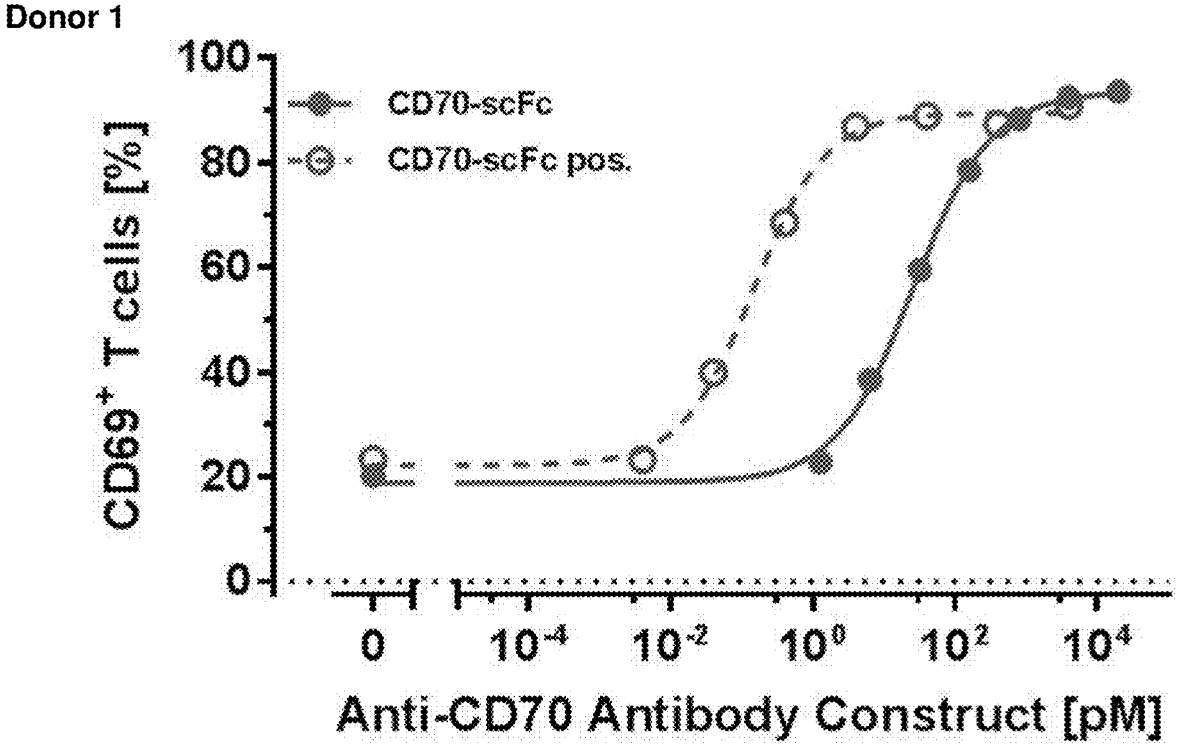
Figure 3Z:
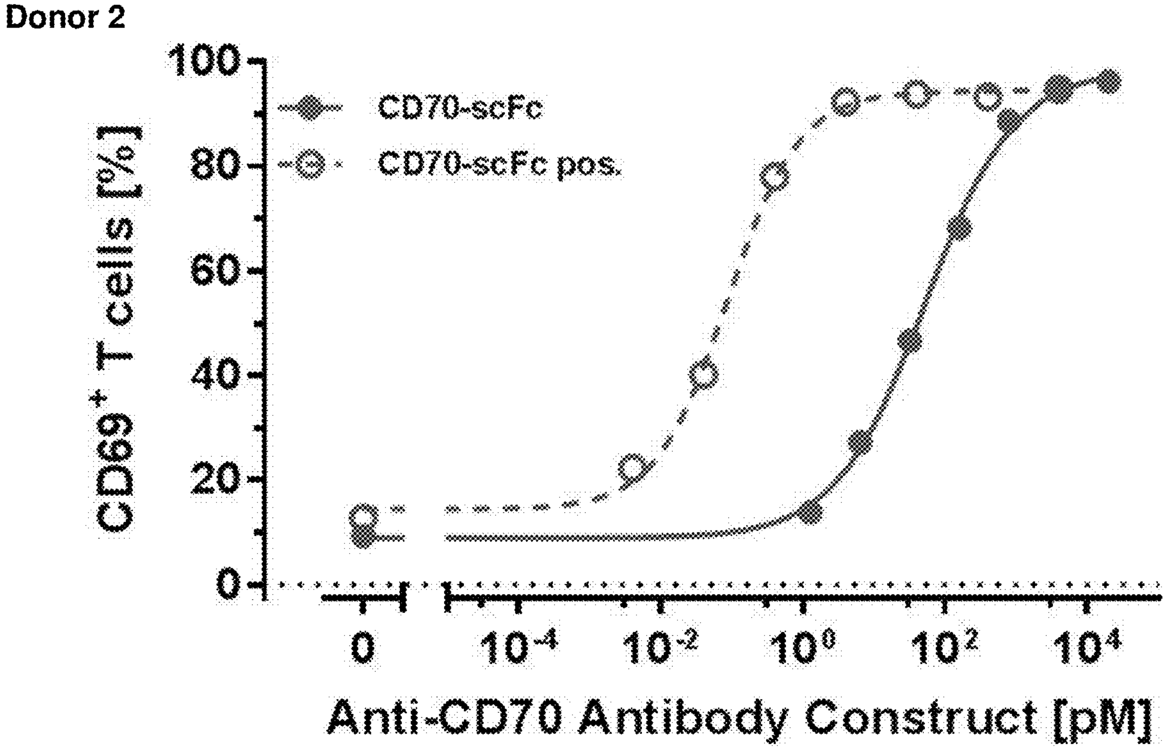
Figure 3A:
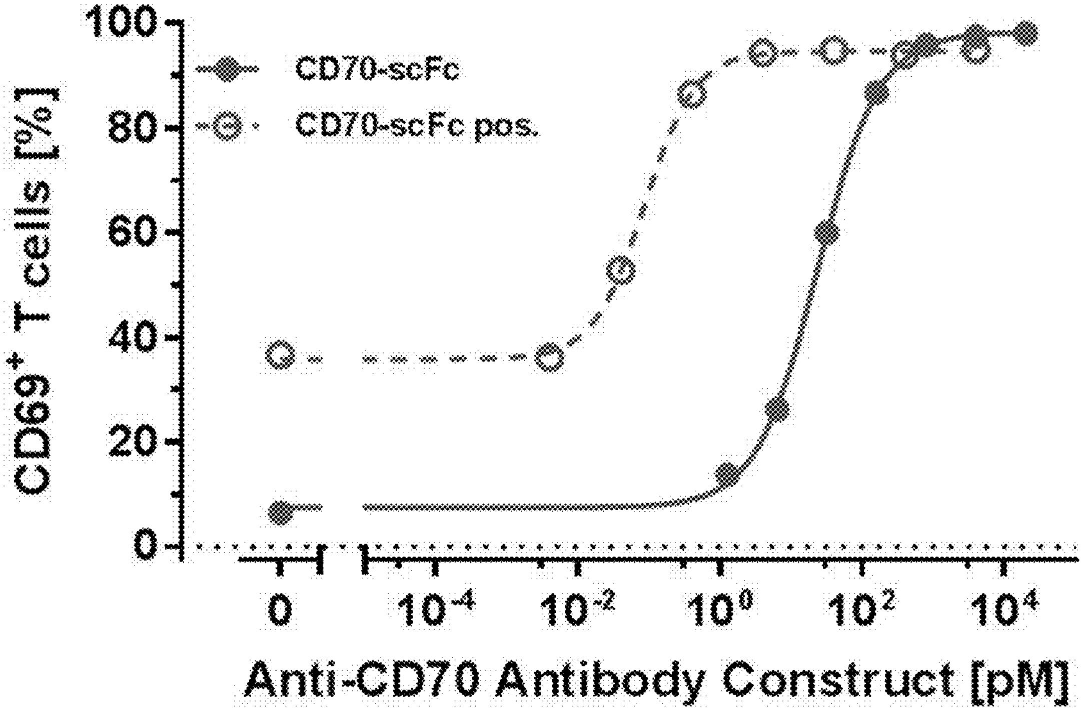
Figure 3A:
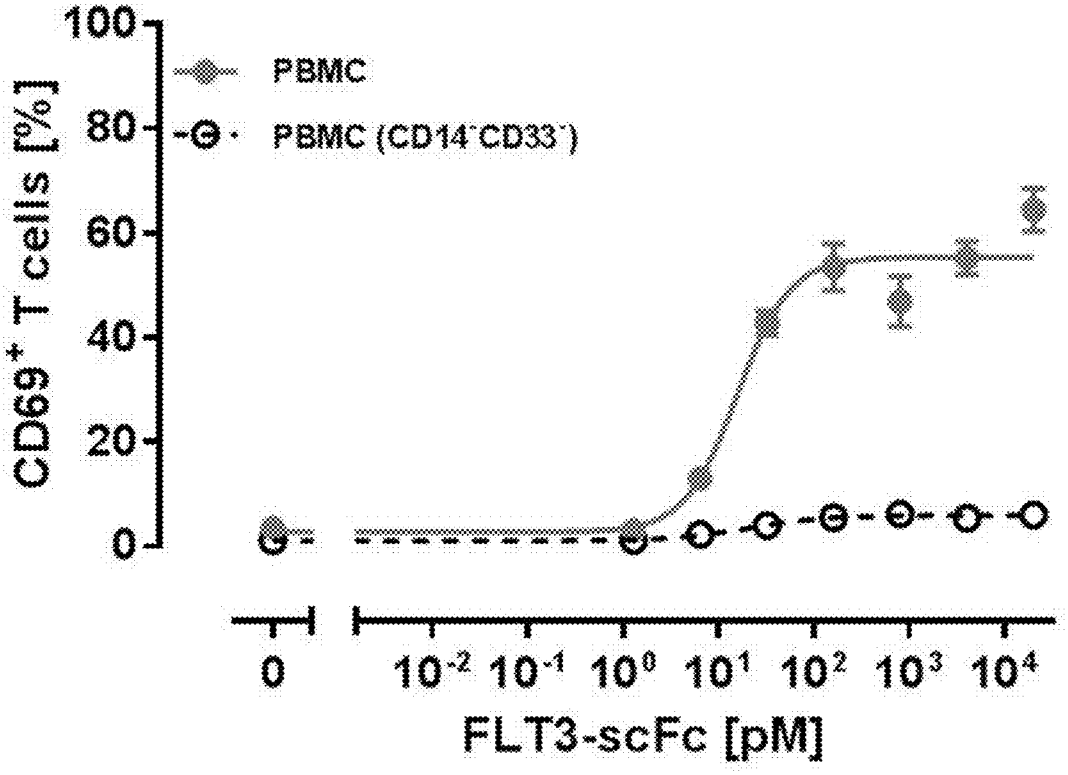

Determination of CD69 expression on CD4+ and CD8+ T cells with flow cytometer and antigen-specific conjugates mAb. Results see FIGS. 3A-3AB.

Target-independent T cell activation in terms of CD69 upregulation was observed for several bispecific constructs tested in these assays. The CD69 upregulation was in general more pronounced for the canonical BiTE® antibody constructs, heteroFc and crossbody molecules when compared to the respective scFc constructs. Upregulation of CD69 by the scFc constructs occurred in general at slightly higher concentrations and the amplitude was in part lower compared to the other two Fc-based constructs.

For the anti-CDH19 scFc construct no target-independent T cell activation was observed, while the heteroFc and X-Body constructs induced a strong upregulation of CD69 on the cell surface of T cells in the absence of target cells.

In addition, no target cell-independent upregulation of CD69 was observed in assays using anti-CD33 and anti-Flt-3 constructs. Due to the expression of the target on cells of the myeloid lineage, these cells had been removed prior to assay set up. These data indicate that an interaction of the Fc regions of the bispecific constructs with FcγR-expressing cells might be responsible for the target-independent induction of CD69 on T cells.

The strong upregulation of CD69 on T cells by the anti-CD70-scFc construct in the absence of a tumor cell lines is due to the expression of CD70 on T cells.

Materials and Methods

1. CD19

Target-independent T cell activation induced by a BiTE® antibody constructs containing a single chain-Fc for the following construct:

1. BiTE® antibody construct (serial dilutions: 1.3 pM-20 nM)
    1. CD19-scFc
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

2. CD20

Target-independent T cell activation induced by BiTE® antibody constructs containing a single chain-Fc, hetero-Fc or crossbody fusion at the C-terminus was evaluated for the following constructs:

1. BiTE® antibody constructs (serial dilutions: 1.3 pM-20 nM)
    1. CD20-hetFc (hetero-Fc)
    2. CD20-scFc
    3. CD20-X-Body (CD20 Crossbody)
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

3. CD33

Target-independent T cell activation induced by BiTE® antibody constructs containing a single chain-Fc, hetero-Fc or crossbody fusion at the C-terminus was evaluated for the following constructs:

1. BiTE® antibody constructs (serial dilutions: 1.3 pM-20 nM)
    1. CD33-canonical
    2. CD33-scFc
    3. CD33-hetFc
    4. CD33-X-Body
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

4. CDH19

Target-independent T cell activation induced by BiTE® antibody constructs containing a single chain-Fc, hetero-Fc or crossbody fusion at the C-terminus was evaluated for the following constructs:

1. BiTE® antibody constructs (serial dilutions: 1.3 pM-20 nM)
    1. CDH19-scFc
    2. CDH19-hetFc
    3. CDH19-X-Body
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

5. MSLN

Target-independent T cell activation induced by BiTE® antibody constructs containing a single chain-Fc, hetero-Fc or crossbody fusion at the C-terminus was evaluated for the following constructs:

1. BiTE® antibody constructs (serial dilutions: 1.3 pM-20 nM)
   1. MSLN-scFc
   2. MSLN-hetFc
   3. MSLN-X-Body
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

6. EGFRvIII

Target-independent T cell activation induced by BiTE® antibody constructs containing a single chain-Fc or a hetero-Fc was evaluated for the following constructs:

1. BiTE® antibody constructs (serial dilutions: 1.3 pM-20 nM)
   1. EGFRvIII-canonical
   2. EGFRvIII-scFc
   3. EGFRvIII-hetFc
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

7. DLL3

Target-independent T cell activation induced by BiTE® antibody constructs containing a single chain-Fc or a hetero-Fc was evaluated for the following constructs:

1. BiTE® antibody constructs (serial dilutions: 1.3 pM-20 nM)
   1. DLL3-canonical
   2. DLL3-scFc
   3. DLL3-hetFc
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

8. CD70

Target-independent T cell activation induced by a BiTE® antibody constructs containing a single chain-Fc was evaluated for the following construct:

1. BiTE® antibody construct (serial dilutions: 1.3 pM-20 nM)
   1. CD70-scFc
2. Human PBMC effector cells (3 donors)
3. 48 h incubation time
4. Flow cytometric analysis of CD69 expression on CD4+ and CD8+ T cells using a PE-Cy7 conjugated mAb specific for CD69.

9. FLT3

Target-independent T cell activation induced by a BiTE® antibody constructs containing a single chain-Fc was evaluated for the following construct:

1. BiTE® antibody construct (serial dilutions: 1.3 pM-20 nM)
   1. FLT3-scFc
2. Human PBMC effector cells (3 donors; $CD14^{+}/CD33^{+}$ cell depleted)
3. 48 h incubation time
4. Flow cytometric analysis of CD69 expression on CD4+ and CD8+ T cells using a PE-Cy7 conjugated mAb specific for CD69.

Example 2

Purified BiTE® antibody constructs were coated on a Maxisorb Plate in decreasing concentration (100 nM, 1:4 dilutions). After 3× washing with PBS-T and blocking with PBS/3% (w/v) BSA (60 min, 37° C.), pooled human plasma was incubated for 60 min, 80 rpm at room temperature. After 3× washing a mouse monoclonal antibody specific for human C1q subunit A (CC1q) was added (Thermo MA1-83963, 1:500) for 60 min, 80 rpm, room temperature, after described washing steps a goat anti mouse Fc-POX mAb (1:5,000) was incubated for 60 min, 80 rpm, room temperature. After additional washing, TMB substrate was incubated and stopped after colorimetric reaction by addition of $H_2SO_4$. The absorption was determined at 450 nm.

Figure 4:
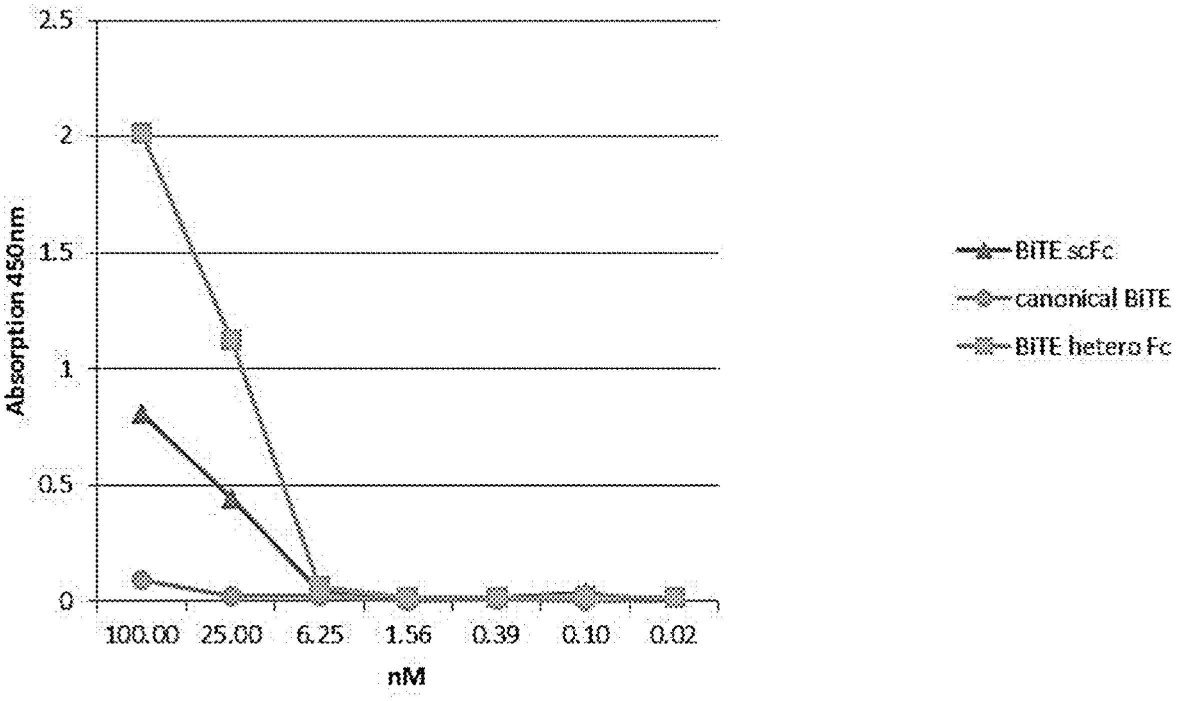
FIG. 4: Complement C1q Binding of BiTE® Fc fusion antibody constructs. BiTE® Fc fusion antibody constructs (BiTE® single chain Fc (triangle), BiTE® hetero Fc (squares), canonical BiTE® (circle)) were coated on a Maxisorp plate (in dilution series), prior to incubation with pooled human serum and incubation with polyclonal anti human CC1q murine antibody, visualized by goat anti-mouse Fc-AP conjugate.
Figure 5A:
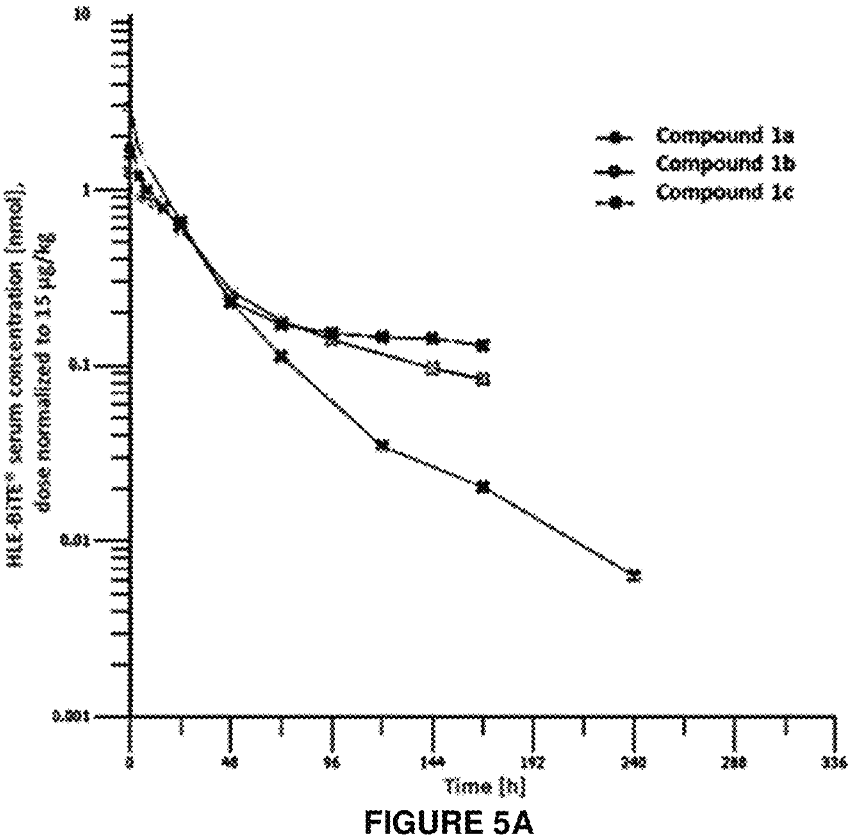
FIGS. 5A-5E: Mean PK profiles of four pairs of BiTE®-HLE fusion antibody constructs after single dose administration in cynomolgus monkeys. For reasons of comparability, serum concentrations were dose-normalized to 15 μg/kg and indicated in nmol.
Figure 5B:
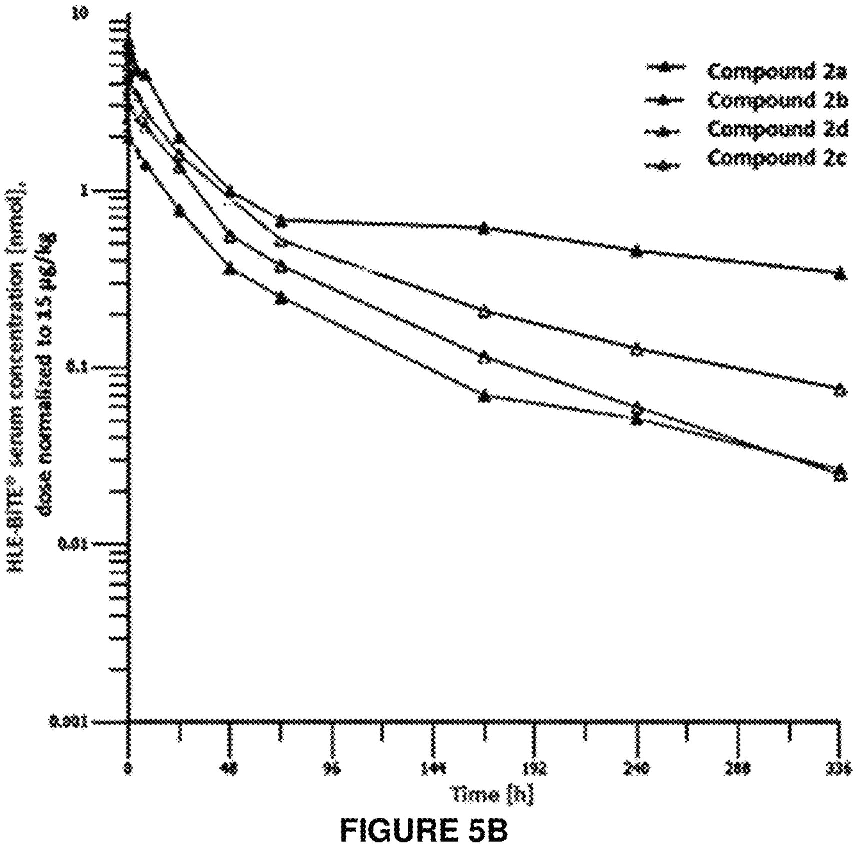
Figure 5C:
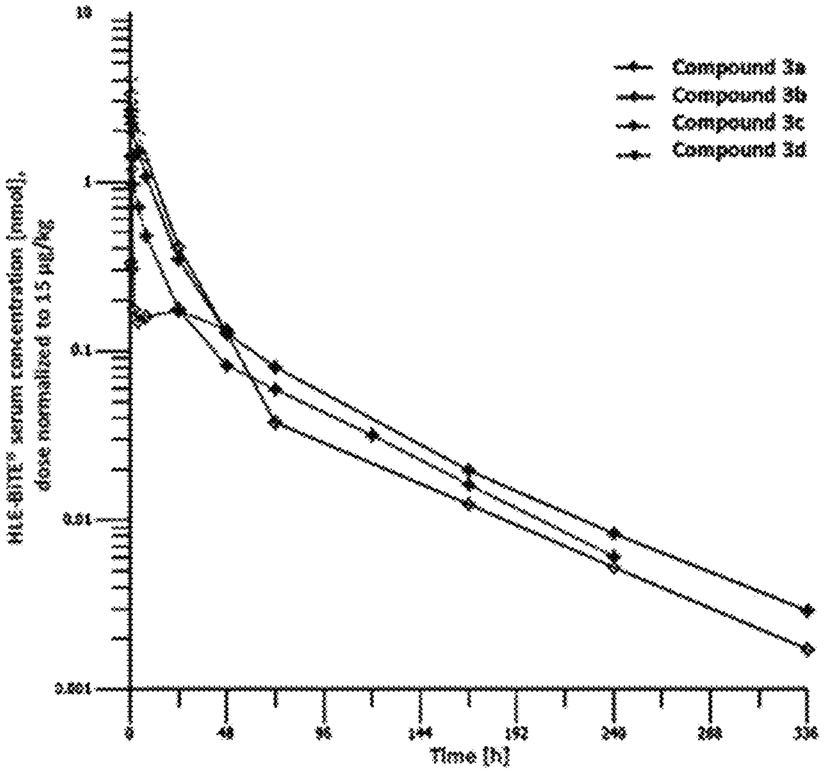
Figure 5D:
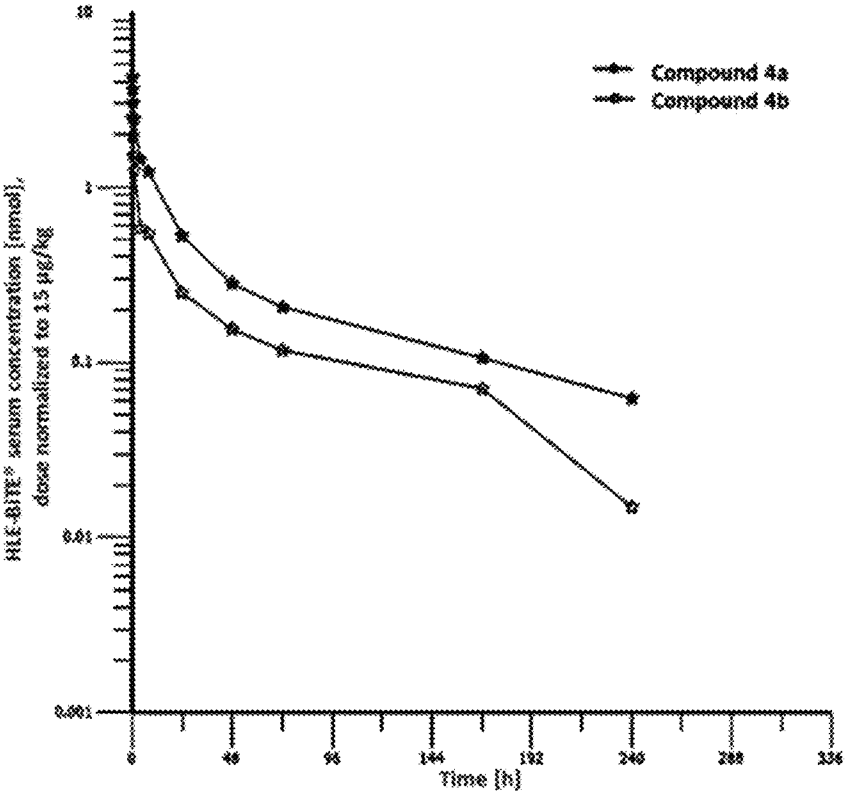
Figure 5E:
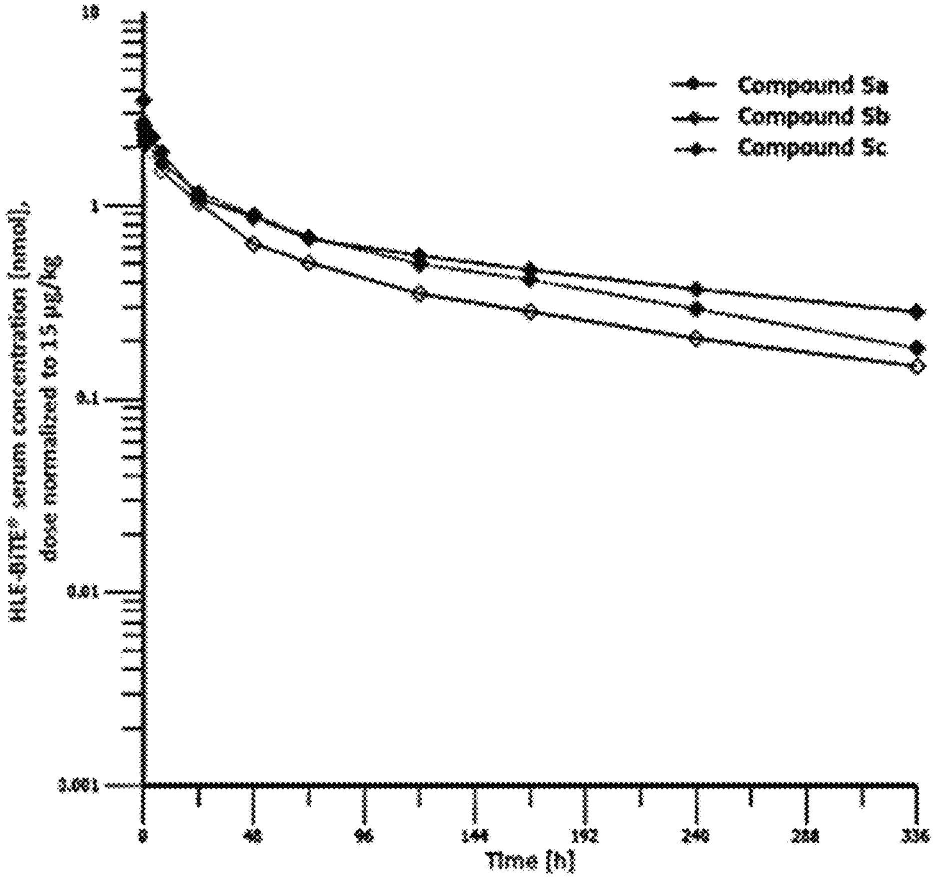

Result: As shown in FIG. 4 at high concentrations, the BiTE® hetero Fc antibody construct (squares) showed higher binding signals for human CC1q compared to a BiTE® single chain Fc antibody construct (triangle). As a negative control a canonical BiTE® (circle) was used, which showed no significant CC1q binding.

Example 3: Pharmacokinetics of BiTE® Antibody Constructs Fused to Half-Life Extension Modalities Various target binding BiTE® antibody constructs were fused to four different half-life extending moieties. All different HLE-variants available per BiTE® antibody construct were tested in the cynomolgus monkey in the context of pharmacokinetic (PK) studies They are subsequently named as BiTE®-scFc, BiTE®-hetFc, BiTE®-HALB, BiTE®-Xbody as well as canonical BiTE®, according to the half-life extension modality attached to the target binder. The corresponding nomenclature of these molecules is briefly summarized in table 4 below.

TABLE 4

Compound nomenclature of single dosed BiTE ® antibody constructs

| compound synonyme | test compound name |
|---|---|
| Compound 1a | CD33-scFc |
| Compound 1b | CD33-hetFc |
| Compound 1c | CD33-HALB |
| Compound 2a | MSLN-scFc |
| Compound 2b | MSLN-hetFc |
| Compound 2c | MSLN-HALB |
| Compound 2d | MSLN-Xbody |
| Compound 3a | CDH19-scFc |
| Compound 3b | CDH19-hetFc |
| Compound 3c | CDH19-HALB |
| Compound 3d | CDH19-H6 |
| Compound 4a | CD20-scFc |
| Compound 4b | CD20-hetFc |
| Compound 5a | DLL3-scFc |
| Compound 5b | DLL3-hetFc |
| Compound 5c | DLL3-HALB |
| Compound 6a | EGFRvIIIcc-scFc |
| Compound 6b | EGFRvIIIcc-HALB |
| Compound 7 | FLT3-scFc |
| Compound 8 | CD70-scFc |
| Compound 9 | CD19cc-scFc |

The BiTE®-HLE antibody constructs were administered as intravenous bolus (compounds 1b, 2a-d, 3a/b, 4a/b, 5a-5c, 7-9) and intravenous infusion (compounds 1a, 1c, 3c/d, 6a/b, each as a 30 min infusion). The BiTE® antibody constructs were administered in a dose-linear, pharmacokinetic relevant range of 3 μg/kg to 6 μg/kg, 12 μg/kg and 15 μg/kg, respectively.

For reasons of comparability the serum concentrations shown are dose-normalized and molecular weight-normalized (described in nmol).

For each of the above named compounds a group of at least two to three animals was used. Blood samples were collected and serum was prepared for determination of serum concentrations. Serum BiTE® antibody construct levels were measured using an immunoassay. The assay is performed by capturing the BiTE® antibody construct via its target moiety, while an antibody directed against the CD3-binding part of the construct was used for detection. The serum concentration-time profiles were used to determine PK parameters.

The appropriate study set-up was adjusted to the characteristics of the BiTE® antibody constructs. Either a 1-week- or a 2-weeks duration. Blood sampling time points could slightly vary and are listed for both set-ups in Table 5 below.

TABLE 5

Blood sampling time points during PK studies. Time points could vary between single studies. Time points labelled with an asterisk were mandatory and common for all studies

| blood sampling time points: 1-week study duration [h] | blood sampling time points: 2-week study duration [h] |
|---|---|
| 0.05/0.085* | 0.05/0.085* |
| 0.25 | 0.25 |
| 0.5 | 0.5 |
| 1 | 1 |
| 2 | 2 |
| 4* | 4* |
| 8 | 8 |
| 16 | 16 |
| 24* | 24* |
| 48* | 48* |
| 72* | 72* |
| 96 | 96 |
| 120 | 120 |
| 144 | 144 |
| 168* | 168* |
| | 216 |
| | 240 |
| | 264 |
| | 336* |

The pharmacokinetics of sixteen BiTE®-HLE antibody constructs are shown exemplarily. Each compound group stands for the same BiTE® antibody construct fused to either a scFc-, a hetFc, a HSA (human albumin) or a Crossbody-Fc format. For all proteins serum levels were quantifiable for all time points in all animals after BiTE®-HLE antibody construct administration. The PK profiles describe a biphasic, exponential decline after each of the single test item administrations (FIGS. 5A-5E).

The pharmacokinetic parameters were determined using standard non-compartmental analysis (NCA) methods. Using non-compartmental analysis, the following PK parameters were estimated: AUCinf (Area under the serum concentration-time curve), Vss (volume of distribution at steady state), CL (systemic clearance) and terminal t½ (terminal half-life).

The PK parameter for each tested compound are summarized as mean of n=2 and n=3, respectively in Table 6 below.

TABLE 6

Pharmacokinetic parameter of various HLE variants from different BiTE ®-target binders in cynomolgus monkeys.

| test item | terminal $t_{1/2}$ [h] | $AUC_{inf}$ [normalized to 15 µg/kg] [h*ng/mL] | Cl [mL/h/kg] | Vss [mL/kg] |
|---|---|---|---|---|
| Compound 1a | 167 | 9981 | 1.4 | 256 |
| Compound 1b | 95 | 6159 | 2.4 | 235 |
| Compound 1c | 47 | 4498 | 3.3 | 161 |
| Compound 2a | 213 | 41173 | 0.4 | 89 |
| Compound 2b | 116 | 18745 | 0.8 | 78 |
| Compound 2c | 77 | 28928 | 1.0 | 65 |
| Compound 2d | 77 | 9825 | 1.5 | 112 |
| Compound 3a | 61 | 4109 | 3.7 | 129 |
| Compound 3b | 59 | 4561 | 3.3 | 78 |
| Compound 3c | 51 | 2769 | 6.8 | 299 |
| Compound 3d | 3 | 510 | 30.0 | 653 |
| Compound 4a | 97 | 7816 | 1.9 | 181 |
| Compound 4b | 62 | 3606 | 4.2 | 292 |
| Compound 5a | 234 | 30954 | 0.5 | 144 |
| Compound 5b | 173 | 18299 | 0.8 | 166 |
| Compound 5c | 142 | 26418 | 0.6 | 103 |
| Compound 6a | 97 | 15854 | 1.0 | 103 |
| Compound 6b | 48 | 77271 | 1.0 | 64 |
| Compound 7 | 64 | 1971 | 7.6 | 395 |
| Compound 8 | 122 | 17093 | 0.9 | 119 |
| Compound 9 | 210 | 6729 | 2.2 | 540 |

Overall, the $AUC_{inf}$ for the different BiTE® target binders fused to either a scFc-, a hetFc, a HSA- and a crossbody HLE-modality, respectively, ranged between 1971 h*ng/mL and 77271 h*ng/mL, depending on the BiTE® target context. All analyzed HLE fusions achieved systemic clearance values of 0.4 to 7.6 mL/h/kg. The corresponding volumes of distribution ranged between 64 and 540 mL/kg. Compound 3d, the canonical, non-half-life extended compound 3 BiTE® target binder, is included as a reference. Non-half-life extended BiTE® antibody constructs show high clearances, low serum exposures and as a consequence a short terminal half-life. A comparison of terminal-half-lives by modality is summarized in table 7.

TABLE 7

Comparison of terminal-half-lifes by modality investigated in cynomolgus monkeys.

| HLE modality | terminal $t_{1/2}$ [h] |
|---|---|
| Canonical BiTE ® | 3 |
| BiTE ®-scFc | 61-234 |
| BiTE ®-hetFc | 48-173 |
| BiTE ®-HALB | 47-142 |
| BiTE ®-Crossbody | 77 |

Figure 6:
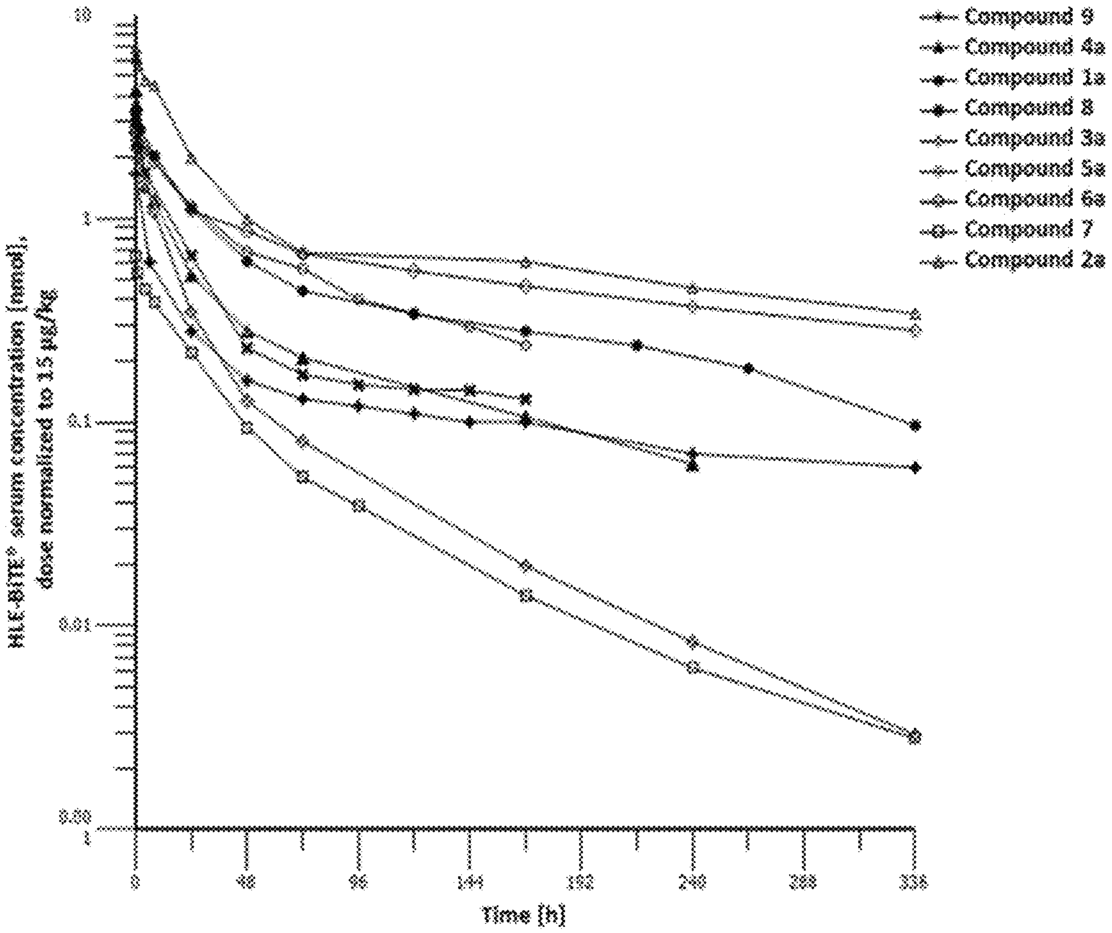
FIG. 6: Mean PK profiles of nine different BiTE® antibody constructs, each fused to a scFc half-life extending moiety. For reasons of comparability, serum concentrations were dose-normalized to 15 μg/kg and indicated in nmol.

Investigating up to four different half-life-extending (HLE) moieties per targeting BiTE® it becomes clear that the -scFc moiety shows an increase of $t_{1/2}$ compared to corresponding other half-life extension moiety after single low dose administration at 6, 10, 12 and 15 µg/kg (see FIG. 6).

Example 4

Preformulated drug substances containing purified MSLN-hALB, MSLN-hFc, and MSLN-scFc respectively were buffer exchanged via ultrafiltration/diafiltration using membranes with a molecular weight cut-off (MWCO) of 10 kDa. Final formulation was achieved by adding concentrated stock solutions. Resulting formulations for each construct are listed in Table 8. The target protein concentration was 1.0 mg/mL. Formulated MSLN constructs were filled to 1 mL in type I glass vials which were stoppered with butyl rubber stoppers and crimped with aluminum seals. Filled vials were incubated at −20, 5, 25 and 37° C. One vial of each version was subjected to five freeze and thaw (F/T) cycles. Target freezing temperature was −29° C. Target thawing temperature was 2° C. The ramp rate was approximately 0.3 K/min.

Visual particles were assessed in accordance to the method described by Ph Eur 2.9.20 by trained operators. Visual particle counts per vial are depicted in Table 8. The number of visual (larger than 125 μm) proteinaceous particles was higher for MSLN-hFc if compared to both MSLN-hALB and MSLN-scFc.

TABLE 8

Number of visual proteinaceous particles per vial for stressed and unstressed (T0) samples containing different half-life extended anti-Mesothelin (MSLN) BiTE ® constructs.

| Construct | hALB | hFc | | scFc | |
|---|---|---|---|---|---|
| Formulation | K60RTrT | K60RTrT | G40MSuT | K60RTrT | G40MSuT |
| Number of visible (>125 μm) proteinaceous particles per vial | | | | | |
| T0 | 0 | 0 | 1 | 0 | 0 |
| 5 F/T cycles | 0 | 2 | 2 | 0 | 1 |
| 2 w 5° C. | 0 | 2 | 2 | 0 | 0 |
| 2 w 25° C. | 0 | 2 | 1 | 0 | 0 |
| 2 w 37° C. | 0 | 2 | 2 | 0 | 0 |
| 4 w −20° C. | 0 | 2 | 1 | 0 | 0 |
| 4 w 5° C. | 0 | 1 | 2 | 0 | 0 |
| 4 w 25° C. | 0 | 2 | 2 | 0 | 0 |
| 4 w 37° C. | 0 | 2 | 2 | 0 | 0 |

The samples described above were also analyzed by size exclusion ultra-high performance chromatography (SE-UPLC) in order to quantify the percentaged content of high molecular weight species (HMWS). SE-UPLC was performed on an AcquityH-Class UPLC system (Waters) using an Acquity UPLC BEH200 SEC 150 mm column (Waters). Column temperature was set to 25° C. Separation of size variants was achieved by applying an isocratic method with a flow rate of 0.4 mL/min. The mobile phase was composed of 100 mM sodium phosphate, 250 mM NaCl at pH 6.8. The run time totals 6.0 minutes. Samples were held at 8° C. within the autosampler until analysis. A total amount of 3 μg protein was injected. In order to avoid carry over an intermediate injection with 40% acetonitrile was performed after each sample. Detection was based on fluorescence emission (excitation at 280 nm, emission at 325 nm). Peak integration was performed using Empower® software. Relative area under the curve of HMWS was reported (Table 9).

Fc based constructs exhibited lower HMWS contents in the formulation variant G40MSuT than in K60RTrT independent on the stress condition. It became evident that MSLN-scFc contained less HMWS than MSLN-hFc in both G40MSuT as well as K60RTrT preparations. MSLN-scFc in its preferred formulation (G40MSuT) was less prone to HMWS formation than MSLN-hALB formulated in K60RTrT. In previous experiments this buffer showed improved stabilizing potential for hALB based constructs.

TABLE 9

Overview on HMWS contents in stressed and unstressed (T0) MSLN-hALB, -hFc, and -scFc preparations determined via SE-UPLC

| Construct | hALB | hFc | | scFc | |
|---|---|---|---|---|---|
| Formulation | K60RTrT | K60RTrT | G40MSuT | K60RTrT | G40MSuT |
| % HMWS | | | | | |
| T0 | 1.8 | 6.7 | 3.3 | 2.5 | 1.3 |
| 5 FT cycles | 2.0 | 7.2 | 4.1 | 3.0 | 1.5 |
| 2 w 5° C. | n.t. | n.t. | n.t. | 2.9 | 1.1 |
| 2 w 25° C. | n.t. | 6.6 | 2.7 | 2.4 | 0.5 |
| 2 w 37° C. | 2.6 | 6.3 | 2.1 | 2.7 | 0.3 |
| 4 w −20° C. | 5.9 | 8.7 | 1.6 | 6.6 | 0.3 |
| 4 w 5° C. | 2.0 | 8.2 | 2.8 | 3.6 | 0.6 |
| 4 w 25° C. | 2.2 | 6.8 | 2.6 | 2.7 | 0.4 |
| 4 w 37° C. | 3.5 | 7.6 | 1.9 | 4.3 | 0.3 |

n.t. = not tested

The abundance of chemical modifications upon heat stress (incubation at 37° C.) was monitored by peptide mapping. Protein samples were enzymatically digested and the resulting peptides were separated using reversed phase chromatography. The column eluate was directly injected into the ion source of a mass spectrometer for identification and quantitation of the peptides.

In order to achieve maximum coverage, two separate enzyme digests were performed: once with trypsin and once with chymotrypsin. In each case, the proteins were denatured with guanidinum chloride and then reduced with dithiothreitol (DTT). After incubation in DTT, free cysteine residues were alkylated by the addition of iodoacetic acid. Samples were then buffer exchanged into 50 mM Tris pH 7.8 for digestion. Trypsin and chymotrypsin were added to separate reaction tubes at a ratio of 1:10 (sample:enzyme) each. Samples were digested for 30 min at 37° C. and the reaction was quenched by adding trifluoroacetic acid.

A load of 5 μg of each digest was separately injected onto a Zorbax SB-C18 (Agilent #859700-902) reversed phase column equilibrated in 0.1% (V/V) formic acid (FA). A 156 minutes gradient of up to 90% acetonitrile containing 0.1% FA was used to elute the peptides directly into the electrospray ion source of a Q-Exactive Plus mass spectrometer (Thermo Scientific). Data was collected in data dependent mode using a top 12 method in which a full scan (resolution 70 000; scan range 200-2000 m/z) was followed by high energy collision dissociation (HCD) of the 12 most abundant ions (resolution 17 500).

Peptides were identified based on accurate mass and tandem mass spectrum using in-house software. Identifications were manually verified. Relative quantities of modified and unmodified peptides were calculated based on ion abundance using Pinpoint software (Thermo Scientific).

Percentages of chemical modifications of the complement determining regions (CDRs) and of the half-life extending portion (either hALB or Fc) detected in MSLN-hALB, -hFc, and -scFc preparations are given by Table 10. When comparing similar formulation conditions, it became obvious that overall, chemical modifications were least abundant in scFc constructs.

TABLE 10

Overview on chemical modifications in stressed and unstressed (T0) MSLN-hALB, -hFc, and -scFc preparations determined via peptide mapping

| Construct | hALB | hFc | | scFc | |
|---|---|---|---|---|---|
| Formulation | K60RTrT | K60RTrT | G40MSuT | K60RTrT | G40MSuT |
| % N101 deamidation (CDR) | | | | | |
| T0 | 0.1 | 0.2 | 0.2 | 0.2 | 0.2 |
| 2 w 37° C. | 0.7 | 0.8 | 3.0 | 0.7 | 3.2 |
| 4 w 37° C. | 1.3 | n.t. | 8.5 | n.t. | 6.4 |
| % N162 deamidation (CDR) | | | | | |
| T0 | 3.0 | 1.7 | 1.9 | 2.3 | 2.5 |
| 2 w 37° C. | 15.9 | 11.6 | 2.7 | 15.0 | 3.3 |
| 4 w 37° C. | 26.8 | n.t. | 3.7 | n.t. | 4.1 |
| % M279 oxidation (CDR) | | | | | |
| T0 | 0.6 | 1.4 | 1.6 | 0.6 | 1.0 |
| 2 w 37° C. | 1.2 | 0.8 | 0.8 | 0.6 | 1.0 |
| 4 w 37° C. | 0.9 | n.t. | 0.8 | n.t. | 0.6 |
| % N348 deamidation (CDR) | | | | | |
| T0 | 0.5 | 3.2 | 3.3 | 0.5 | 0.9 |
| 2 w 37° C. | 20.5 | 21.6 | 1.9 | 9.4 | 1.3 |
| 4 w 37° C. | 22.8 | n.t. | 2.0 | n.t. | 2.9 |
| % N351 deamidation (CDR) | | | | | |
| T0 | 0.2 | 2.9 | 2.6 | 0.5 | 1.0 |
| 2 w 37° C. | 6.6 | 12.7 | 0.9 | 3.8 | 0.4 |
| 4 w 37° C. | 8.7 | n.t. | 0.8 | n.t. | 0.8 |
| % M530 oxidation (Fc) | | | | | |
| T0 | n.a. | 3.9 | 4.1 | 2.6 | 3.2 |
| 2 w 37° C. | n.a. | 9.0 | 3.1 | 4.0 | 4.3 |
| 4 w 37° C. | n.a. | n.t. | 3.4 | n.t. | 3.5 |
| % N603 deamidation (Fc) | | | | | |
| T0 | n.a. | 1.3 | 1.9 | 1.3 | 1.4 |
| 2 w 37° C. | n.a. | 7.9 | 4.6 | 7.0 | 5.6 |
| 4 w 37° C. | n.a. | n.t. | 6.9 | n.t. | 8.1 |
| % M706 oxidation (Fc) | | | | | |
| T0 | n.a. | 3.2 | 3.6 | 1.5 | 2.1 |
| 2 w 37° C. | n.a. | 6.0 | 2.8 | 2.1 | 2.5 |
| 4 w 37° C. | n.a. | n.t. | 2.6 | n.t. | 2.0 |
| % M587 oxidation (hALB) | | | | | |
| T0 | 1.0 | n.a. | n.a. | n.a. | n.a. |
| 2 w 37° C. | 2.2 | n.a. | n.a. | n.a. | n.a. |
| 4 w 37° C. | 2.3 | n.a. | n.a. | n.a. | n.a. |
| % M623 oxidation (hALB) | | | | | |
| T0 | 1.9 | n.a. | n.a. | n.a. | n.a. |
| 2 w 37° C. | 2.4 | n.a. | n.a. | n.a. | n.a. |
| 4 w 37° C. | 3.0 | n.a. | n.a. | n.a. | n.a. |
| % M798 oxidation (hALB) | | | | | |
| T0 | 1.4 | n.a. | n.a. | n.a. | n.a. |
| 2 w 37° C. | 3.3 | n.a. | n.a. | n.a. | n.a. |
| 4 w 37° C. | 3.5 | n.a. | n.a. | n.a. | n.a. |
| % M829 oxidation (hALB) | | | | | |
| T0 | 8.9 | n.a. | n.a. | n.a. | n.a. |
| 2 w 37° C. | 42.9 | n.a. | n.a. | n.a. | n.a. |
| 4 w 37° C. | 44.1 | n.a. | n.a. | n.a. | n.a. |

n.a. = not applicable;
n.t. = not tested

Example 5

MSLN-hALB, -hFc, -scFc formulated as described under Example 4 were subjected to a pH jump experiment. The concentration of the starting materials was 1.0 mg/mL. A volume of 0.38 mL of each starting material was filled in a glass vial. After preconditioning at 37° C. the solutions were spiked with 20 fold phosphate buffered saline (PBS) which was composed of 0.090 M potassium phosphate, 0.480 M sodium phosphate (both dibasic), 0.052 M potassium chloride and 2.76 M NaCl. The spiked samples were incubated at 37° C. for two weeks. After incubation they were analyzed by SE-UPLC using the method described under Example 4 and the percentaged content of HMWS was reported (Table 11). When comparing all constructs formulated in K60RTrT the HMWS content increased in the following order: hALB <scFc <hFc. MSLN-scFc also showed a lower HMWS content than MSLN-hFc when formulated in G40MSuT.

TABLE 11

Overview on HMWS contents in stressed (pH jump + 2 w 37° C.) MSLN-hALB, -hFc, and -scFc preparations determined via SE-UPLC

| Construct | hALB | hFc | | scFc | |
|---|---|---|---|---|---|
| Formulation | K60RTrT | K60RTrT | G40MSuT | K60RTrT | G40MSuT |
| % HMWS | | | | | |
| 2 w 37° C. | 1.5 | 8.3 | 7.1 | 5.4 | 5.1 |

Example 6

MSLN-hALB, -hFc, and -scFc formulated as described under Example 4 were subjected to agitation stress. The concentration of the starting materials was 1.0 mg/mL. A volume of 0.5 mL of each solution was filtered through an appropriate 0.22 μm filter and filled into 3 cc glass vials. The vials were placed in a plastic box ensuring that the vials were not displaced within the box during agitation. The box was placed onto an orbital shaker. The samples were agitated at 500 rpm for 65 hours. Visual particles were assessed in accordance to the method described by Ph Eur 2.9.20. The method was conducted by trained operators. Visual particle counts per vial are depicted in Table 12. Visible proteinaceous particles were only observed in MSLN-hFc preparations.

TABLE 12

Number of visual proteinaceous particles per vial in agitated samples

| Construct | hALB | hFc | | scFc | |
|---|---|---|---|---|---|
| Formulation | K60RTrT | K60RTrT | G40MSuT | K60RTrT | G40MSuT |
| Number of visible (>125 μm) proteinaceous particles per vial | | | | | |
| 65 h, 500 rpm | 0 | 1 | 1 | 0 | 0 |

Above samples were also analyzed by size exclusion ultra-high performance chromatography (SE-UPLC) in order to quantify the percentaged content of high molecular weight species (HMWS). The same method as described in Example 4 was applied. The HMWS contents of agitated samples are outlined by Table 13. The formation of HMWS was most pronounced in MSLN-hFc when comparing K60RTrT preparations. HMWS were more abundant in MSLN-hFc than in MLSN-scFc.

TABLE 13

| Overview on HMWS contents in stressed (pH jump + 2 w 37° C.) MSLN-hALB, -hFc, and -scFc preparations determined via SE-UPLC | | | | | |
|---|---|---|---|---|---|
| Construct | hALB | hFc | | scFc | |
| Formulation | K60RTrT | K60RTrT | G40MSuT | K60RTrT | G40MSuT |
| | % HMWS | | | | |
| 65 h, 500 rpm | 1.8 | 5.8 | 2.4 | 1.8 | 0.3 |

Example 7

MSLN-hALB, -hFc, and -scFc formulated as described under Example 4 were exposed to visible and UVA light (photo stress). Protein concentration totaled 1 mg/mL in all preparations. Protein solutions were filtered through a filter with 0.22 μm pore size and filled to 0.5 mL in type I glass vials. MSLN-hALB and -scFc were subjected to two different tests including 0.2 MLux visible light/25 W*h/m$^2$ UVA light and 1.2MLux visible light/173 W*h/m$^2$ respectively. MSLN-hFc was subjected to two different tests including 0.2 MLux visible light without UVA light and 1.2 MLux visible light/30 W*h/m$^2$ UVA light respectively. Chamber temperatures were adjusted to 25° C. After light exposure samples were analyzed by visible inspection (Table 14), SE-UPLC (Table 15) and peptide map (Table 16). Aforementioned methods were performed according to the procedures described under Example 4. Although MSLN-hALB, and -scFc were exposed to higher doses of UVA light, no visible proteinaceous particles was observed whereas MSLN-hFc samples exhibited one visible proteinaceous particle per vial for both tests irrespective of the formulation.

TABLE 14

| Overview on the number of visible proteinaceous particles per vial in MSLN-hALB, -hFc, and -scFc preparations determined after light exposure | | | | | |
|---|---|---|---|---|---|
| Construct | hALB | hFc | | scFc | |
| Formulation | K60RTrT | K60RTrT | G40MSuT | K60RTrT | G40MSuT |
| | Number of visible (>125 μm) proteinaceous particles per vial | | | | |
| T0 | 0 | 0 | 1 | 0 | 0 |
| Test 1 | 0$^{1)}$ | 1$^{2)}$ | 1$^{2)}$ | 0$^{1)}$ | 0$^{1)}$ |
| Test 2 | 0$^{3)}$ | 1$^{4)}$ | 1$^{4)}$ | 0$^{3)}$ | 0$^{3)}$ |

$^{1)}$0.2 MLux visible light/25 W * h/m$^2$ UVA light,
$^{2)}$0.2 MLux visible light without UVA light,
$^{3)}$1.2 MLux visible light/173 W * h/m$^2$,
$^{4)}$1.2 MLux visible light/30 W * h/m$^2$ HMWS increased in the following order MSLN-hALB <-scFc <-hFc when the protein was formulated in K60RTrT. HMWS could be reduced for Fc based constructs when formulated in G40MSuT. However HMWS were again less pronounced for MSLN-scFc. MSLN-hFc revealed to be especially sensitive towards UVA light exposure.

TABLE 15

| Overview on HMWS contents in MSLN-hALB, -hFc, and -scFc preparations determined after light exposure via SE-UPLC | | | | | |
|---|---|---|---|---|---|
| Construct | hALB | hFc | | scFc | |
| Formulation | K60RTrT | K60RTrT | G40MSuT | K60RTrT | G40MSuT |
| | % HMWS | | | | |
| T0 | 1.8 | 6.7 | 3.3 | 2.5 | 1.3 |
| Test 1 | 1.8$^{1)}$ | 6.3$^{2)}$ | 2.5$^{2)}$ | 2.1$^{1)}$ | 0.4$^{1)}$ |
| Test 2 | 2.0$^{3)}$ | 11.0$^{4)}$ | 2.1$^{4)}$ | 2.4$^{3)}$ | 0.3$^{3)}$ |

$^{1)}$0.2 MLux visible light/25 W * h/m$^2$ UVA light,
$^{2)}$0.2 MLux visible light without UVA light,
$^{3)}$1.2 MLux visible light/173 W * h/m$^2$,
$^{4)}$1.2 MLux visible light/30 W * h/m$^2$ Percentages of chemical modifications of the complement determining regions (CDRs) and of the half-life extending portion (either hALB or Fc) detected in MSLN-hALB, -hFc, and -scFc preparations are given by Table 16. When comparing similar formulation conditions, it became obvious that overall, chemical modifications were least abundant in scFc constructs.

TABLE 16

| Overview on chemical modifications in MSLN-hALB, -hFc, and -scFc preparations determined after light exposure via peptide mapping | | | | | |
|---|---|---|---|---|---|
| Construct | hALB | hFc | | scFc | |
| Formulation | K60RTrT | K60RTrT | G40MSuT | K60RTrT | G40MSuT |
| | % N101 deamidation (CDR) | | | | |
| T0 | 0.1 | 0.2 | 0.2 | 0.2 | 0.2 |
| Test 1 | 0.2$^{1)}$ | n.t. | 0.3$^{2)}$ | n.t. | 0.5$^{1)}$ |
| Test 2 | 0.2$^{3)}$ | n.t. | 0.6$^{4)}$ | n.t. | 0.7$^{3)}$ |
| | % N162 deamidation (CDR) | | | | |
| T0 | 3.0 | 1.7 | 1.9 | 2.3 | 2.5 |
| Test 1 | 3.0$^{1)}$ | n.t. | 2.1$^{2)}$ | n.t. | 2.7$^{1)}$ |
| Test 2 | 3.6$^{3)}$ | n.t. | 3.1$^{4)}$ | n.t. | 2.8$^{3)}$ |
| | % M279 oxidation (CDR) | | | | |
| T0 | 0.6 | 1.4 | 1.6 | 0.6 | 1.0 |
| Test 1 | 0.8$^{1)}$ | n.t. | 2.6$^{2)}$ | n.t. | 0.6$^{1)}$ |
| Test 2 | 1.0$^{3)}$ | n.t. | 6.3$^{4)}$ | n.t. | 0.7$^{3)}$ |
| | % N348 deamidation (CDR) | | | | |
| T0 | 0.5 | 3.2 | 3.3 | 0.5 | 0.9 |
| Test 1 | 0.4$^{1)}$ | n.t. | 2.7$^{2)}$ | n.t. | 0.2$^{1)}$ |
| Test 2 | 0.9$^{3)}$ | n.t. | 3.9$^{4)}$ | n.t. | 0.2$^{3)}$ |
| | % N351 deamidation (CDR) | | | | |
| T0 | 0.2 | 2.9 | 2.6 | 0.5 | 1.0 |
| Test 1 | 0.4$^{1)}$ | n.t. | 2.0$^{2)}$ | n.t. | 0.3$^{1)}$ |
| Test 2 | 0.5$^{3)}$ | n.t. | 2.6$^{4)}$ | n.t. | 0.3$^{3)}$ |
| | % M530 oxidation (Fc) | | | | |
| T0 | n.a. | 3.9 | 4.1 | 2.6 | 3.2 |
| Test 1 | n.a. | n.t. | 7.6$^{2)}$ | n.t. | 3.1$^{1)}$ |
| Test 2 | n.a. | n.t. | 21.8$^{4)}$ | n.t. | 4.1$^{3)}$ |
| | % M706 oxidation (Fc) | | | | |
| T0 | n.a. | 3.2 | 3.6 | 1.5 | 2.1 |
| Test 1 | n.a. | n.t. | 6.5$^{2)}$ | n.t. | 1.8$^{1)}$ |
| Test 2 | n.a. | n.t. | 17.8$^{4)}$ | n.t. | 2.7$^{3)}$ |
| | % M587 oxidation (hALB) | | | | |
| T0 | 1.0 | n.a. | n.a. | n.a. | n.a. |
| Test 1 | 1.5 | n.a. | n.a. | n.a. | n.a. |
| Test 2 | 2.4 | n.a. | n.a. | n.a. | n.a. |

TABLE 16-continued

Overview on chemical modifications in MSLN-hALB, -hFc, and -scFc preparations determined after light exposure via peptide mapping

| Construct | hALB | hFc | | scFc | |
|---|---|---|---|---|---|
| Formulation | K60RTrT | K60RTrT | G40MSuT | K60RTrT | G40MSuT |
| % M623 oxidation (hALB) | | | | | |
| T0 | 1.9 | n.a. | n.a. | n.a. | n.a. |
| Test 1 | 4.0 | n.a. | n.a. | n.a. | n.a. |
| Test 2 | 4.1 | n.a. | n.a. | n.a. | n.a. |
| % M798 oxidation (hALB) | | | | | |
| T0 | 1.4 | n.a. | n.a. | n.a. | n.a. |
| Test 1 | 2.1 | n.a. | n.a. | n.a. | n.a. |
| Test 2 | 3.1 | n.a. | n.a. | n.a. | n.a. |
| % M829 oxidation (hALB) | | | | | |
| T0 | 8.9 | n.a. | n.a. | n.a. | n.a. |
| Test 1 | 31.0 | n.a. | n.a. | n.a. | n.a. |
| Test 2 | 25.2 | n.a. | n.a. | n.a. | n.a. |

n.a. = not applicable;
n.t. = not tested

Example 8

MSLN-hALB was formulated in K60RTrT and MSLN-scFc was formulated in G40MSuT according to the procedure described in Example 4. Protein concentrations totaled 0.05 mg/mL. Glass (borosilicate, type I, 13 mm 3 cc vial from West, Art. No. 68000375) and polypropylene test containers (2 mL with O-ring, e.g. from Sarstedt, Art No. 72.694.005) are filled with 500 μL of the test solution. The test solution was left for five minutes in the first test container. Then a 150 μL aliquot was sampled for analysis. The remaining test solution (350 μL) was transferred sequentially from one test container to the next (five containers in total). In each vial, the solution was left for five minutes before the next transfer. The same pipette tip was used for each transfer step. The same test was performed using 30 mL polycarbonate bottles (Nalgene, PCS-000295 with closure, PP/20-415/ZTPE). For this container type the first container was filled with 5 mL. After a 150 μL aliquot was sampled, the residual volume was transferred from one test container to the next (according to the procedure described above). Samples pulled from container #1 and #5 were analyzed by SE-UPLC (method as described under Example 4). In addition protein detection was carried out with a PDA detector (280 nm) in order to determine protein concentrations. Percentaged protein recovery from each test container is given by Table 17. It was shown that protein recovery was more pronounced for MSLN-scFc than for MSLN-hALB irrespective of the container type.

TABLE 17

Protein recovery from different container types for MSLN-hALB, and -scFc determined by SE-UPLC

| Construct<br>Formulation | hALB<br>K60RTrT | scFc<br>G40MSuT |
|---|---|---|
| % Protein recovery (from nominal) | | |
| Type I glass | 80.0 | 92.0 |
| Polypropylene | 87.0 | 97.3 |
| Polycarbonate | 87.0 | 96.0 |

Example 9

MSLN-hALB was formulated in K60RTrT and MSLN-scFc was formulated in K60RTrT and G40MSuT according to the procedure described in Example 4. The protein concentration totaled 1.0 mg/mL. 1950 μL of each test solution was spiked with 50 μL of a 1000 ppm silicon standard solution (Specpure from AlfaAesar, Art. No. 38717) resulting in a 25 ppm spike. An unspiked test solution served as control sample. The spiked test solution as well as the control sample were filled into 3 cc type I glass vials and were incubated at 37° C. for 24 hours. All samples were analyzed by SE-UPLC according to the method described in Example 4 in order to quantify the amount of HMWS (Table 18). When formulated in K60RTrT, MSLN-hALB and -scFc showed similar increases in HMWS upon silicon spiking.

TABLE 18

Overview on HMWS contents in MSLN-hALB, and -scFc preparations determined via SE-UPLC after spiking with 25 ppm silicon

| Construct | hALB | scFc | |
|---|---|---|---|
| Formulation | K60RTrT | K60RTrT | G40MSuT |
| Δ % HMWS (compared to unspiked control) | | | |
| 25 ppm spike | 1.0 | 1.0 | 0.2 |

Example 10

Preformulated drug substances containing purified CD33 cc-hALB, CD33 cc-hFc, and CD33 cc-scFc respectively were buffer exchanged via ultrafiltration/diafiltration using membranes with a molecular weight cut-off (MWCO) of 10 kDa. Final formulation was achieved by adding concentrated stock solutions. Resulting formulations for each construct are listed in Table 19. The target protein concentration was 1.0 mg/mL. Formulated CD33 cc-constructs were filled to 1 mL in type I glass vials which were stoppered with butyl rubber stoppers and crimped with aluminum seals. Filled vials were incubated at −20, 5, 25 and 37° C. One vial of each version was subjected to five freeze and thaw (F/T) cycles. Target freezing temperature was −29° C. Target thawing temperature was 2° C. The ramp rate was approximately 0.3 K/min. The samples described above were also analyzed by size exclusion ultra-high performance chromatography (SE-UPLC) in order to quantify the percentage content of high molecular weight species (HMWS). SE-UPLC was performed according to the method described under Example 4. When formulated in K60RTrT, HMWS increased in the following order in unstressed samples: scFc <hALB <hFc. The least pronounced increase in HMWS upon freeze thaw stress was observed for the scFc-construct. The hFc-construct revealed to be most prone to HMWS formation at −20° C. HMWS contents increased after four weeks storage at 5° C. The HMWS formation under these conditions was more pronounced for Fc based constructs than for albumin based constructs. In K60RTrT no significant increases in HMWS were observed at elevated storage temperatures (25 and 37° C.). When formulated in G40MSuT, all constructs revealed similar HMWS contents in unstressed samples. The increase during freeze thaw was more distinct for Fc based constructs if compared to the albumin based construct. In G40MSuT, the hFc-construct was least stable during storage at −20° C. Considerable increases in HMWS during liquid storage were only observed for the hALB-construct.

TABLE 19

Overview on HMWS contents in stressed and unstressed (T0) CD33cc-hALB, –hFc, and –scFc preparations determined via SE-UPLC

| Construct | hALB | | hFc | | scFc | |
|---|---|---|---|---|---|---|
| Formulation | K60RTrT | G40MSuT | K60RTrT | G40MSuT | K60RTrT | G40MSuT |
| | % HMWS | | | | | |
| T0 | 1.5 | 0.3 | 2.7 | 0.3 | 1.3 | 0.3 |
| 5 F/T cycles | 2.0 | 0.5 | 3.1 | 0.7 | 1.6 | 0.7 |
| 2 w −20° C. | n.t | n.t | n.t | n.t | 1.5 | 0.5 |
| 2 w 5° C. | n.t | n.t | n.t | n.t | 1.8 | 0.2 |
| 2 w 25° C. | 1.7 | 0.6 | 2.3 | 0.2 | 1.3 | 0.2 |
| 2 w 37° C. | 1.9 | 0.7 | 1.8 | 0.2 | 1.2 | 0.2 |
| 4 w −20° C. | 1.6 | 0.4 | 4.2 | 1.5 | 1.7 | 0.9 |
| 4 w 5° C. | 1.9 | 0.3 | 3.3 | 0.3 | 2.1 | 0.4 |
| 4 w 25° C. | 1.4 | 0.6 | 2.2 | 0.2 | 1.4 | 0.4 |
| 4 w 37° C. | 1.3 | 0.7 | 2.0 | 0.1 | 1.4 | 0.3 |

n.t. = not tested

The abundance of chemical modifications upon heat stress (incubation at 37° C.) was monitored by peptide mapping according to the method described in Example 4. Percentages of chemical modifications of the complement determining regions (CDRs) detected in CD33 cc-hALB, -hFc, and -scFc preparations are given by Table 20. Overall, CD33 cc-scFc exhibited the lowest amount of chemical modifications in the CDRs. It became evident that especially deamidations of the CDRs were least pronounced for the scFc construct.

TABLE 20

Overview on chemical modifications in stressed and unstressed (T0) CD33cc-hALB, –hFc, and –scFc preparations determined via peptide mapping

| Construct | hALB | | hFc | | scFc | |
|---|---|---|---|---|---|---|
| Formulation | K60RTrT | G40MSuT | K60RTrT | G40MSuT | K60RTrT | G40MSuT |
| | % M34 oxidation (CDR) | | | | | |
| T0 | 1.0 | 1.8 | 1.0 | 1.4 | 1.7 | 1.9 |
| 2 w 37° C. | 0.9 | 1.3 | 0.9 | 1.1 | 1.0 | 1.7 |
| 4 w 37° C. | n.t. | n.t. | n.t. | 1.6 | n.t. | 1.8 |
| | % D103 isomerization (CDR) | | | | | |
| T0 | 0.8 | 0.8 | 0.8 | 0.8 | 0.6 | 0.6 |
| 2 w 37° C. | 4.0 | 4.6 | 4.5 | 4.4 | 5.8 | 7.3 |
| 4 w 37° C. | n.t. | n.t. | n.t. | 8.0 | n.t. | 12.4 |
| | % M290 oxidation (CDR) | | | | | |
| T0 | 0.7 | 1.4 | 0.8 | 1 | 1.3 | 1.4 |
| 2 w 37° C. | 0.7 | 1.0 | 0.8 | 0.8 | 0.8 | 1.3 |
| 4 w 37° C. | n.t. | n.t. | n.t. | 1.2 | n.t. | 1.6 |
| | % N359 deamidation (CDR) | | | | | |
| T0 | 5.8 | 11.4 | 5.3 | 6.3 | 0.4 | 0.5 |
| 2 w 37° C. | 19.3 | 5.8 | 11.2 | 2.8 | 7.0 | 0.9 |
| 4 w 37° C. | n.t. | n.t. | n.t. | 2.9 | n.t. | 2.2 |
| | % N362 deamidation (CDR) | | | | | |
| T0 | 5.4 | 8.7 | 3.9 | 4.0 | 0.2 | 0.3 |
| 2 w 37° C. | 13.5 | 3.6 | 6.7 | 1.2 | 3.1 | 0.3 |
| 4 w 37° C. | n.t. | n.t. | n.t. | 1.4 | n.t. | 0.7 |

n.a. = not applicable;

n.t. = not tested

Example 11

CD33 cc-hALB, -hFc, and -scFC formulated as described under Example 4 were subjected to a pH jump experiment. The concentration of the starting materials was 1.0 mg/mL. A volume of 0.38 mL of each starting material was filled in a glass vial. After preconditioning at 37° C. the solutions were spiked with 20 fold phosphate buffered saline (PBS) which was composed of 0.090 M potassium phosphate, 0.480 M sodium phosphate (both dibasic), 0.052 M potassium chloride and 2.76 M NaCl. The spiked samples were incubated at 37° C. for two weeks. After incubation they were analyzed by SE-UPLC using the method described under Example 4 and the percentaged content of HMWS was reported (Table 21). CD33 cc-scFc constructs showed the lowest HMWS content after pH jump if compared to CD33 cc-hALB and -hFc irrespective of the formulation.

TABLE 21

Overview on HMWS contents in stressed (pH jump + 2 w 37° C.) CD33cc-hALB, −hFc, and −scFc preparations determined via SE-UPLC

| Construct | hALB | | hFc | | scFc | |
|---|---|---|---|---|---|---|
| Formulation | K60RTrT | G40MSuT | K60RTrT | G40MSuT | K60RTrT | G40MSuT |
| | % HMWS | | | | | |
| 2 w 37° C. | 1.7 | 4.8 | 1.6 | 1.8 | 1.1 | 1.5 |

Example 12

CD33 cc-hALB, -hFc, and -scFc formulated as described under Example 4 were subjected to agitation stress. The concentration of the starting materials was 1.0 mg/mL. A volume of 0.5 mL of each solution was filter through an appropriate 0.22 μm filter and filled into 3 cc type 1 glass vials. The vials were placed in a plastic box ensuring that the vials were not displaced within the box during agitation. The box was placed onto an orbital shaker. The samples were agitated at 500 rpm for 65 hours. Samples were analyzed by SE-UPLC in order to quantify the percentaged content of high molecular weight species (HMWS). The same method as described in Example 4 was applied. The HMWS contents of agitated samples are outlined by Table 22. The formation of HMWS was least pronounced for CD33 cc-scFc in either formulation.

TABLE 22

Overview on HMWS contents in stressed (pH jump + 2 w 37° C.) CD33cc-hALB, −hFc, and −scFc preparations determined via SE-UPLC

| Construct | hALB | | hFc | | scFc | |
|---|---|---|---|---|---|---|
| Formulation | K60RTrT | G40MSuT | K60RTrT | G40MSuT | K60RTrT | G40MSuT |
| | % HMWS | | | | | |
| 65 h, 500 rpm | 2.1 | 0.8 | 2.3 | 0.4 | 1.3 | 0.2 |

Example 13

CD33 cc-hALB, -hFc, and -scFc formulated as described under Example 4 were exposed to visible and UVA light (photo stress). Protein concentration totaled 1 mg/mL in all preparations. Protein solutions were filtered through a filter with 0.22 μm pore size and filled to 0.5 mL in type I glass vials. CD33 cc-hALB and -scFc were subjected to two different tests including 0.2 MLux visible light/25 W*h/$m^2$ UVA light and 1.2MLux visible light/173 W*h/$m^2$ respectively. CD33 cc-hFc was subjected to two different tests including 0.2 MLux visible light without UVA light and 1.2 MLux visible light/30 W*h/$m^2$ UVA light respectively. Chamber temperatures were adjusted to 25° C. After light exposure samples were analyzed by SE-UPLC (Table 23) and peptide map (Table 24). Aforementioned methods were performed according to the procedures under Example 4. Despite of the higher UVA light intensity applied to CD33 cc-scFc, this construct was stable against HMWS formation.

In contrast,

TABLE 23

Overview on HMWS contents in CD33cc-hALB, -hFc, and -scFc preparations determined after light exposure via SE-UPLC

| Construct | hALB | | hFc | | scFc | |
|---|---|---|---|---|---|---|
| Formulation | K60RTrT | G40MSuT | K60RTrT | G40MSuT | K60RTrT | G40MSuT |
| % HMWS | | | | | | |
| T0 | 1.5 | 0.3 | 2.7 | 0.3 | 1.3 | 0.3 |
| Test 1 | 1.8[1] | 0.3[1] | 2.5[2] | 0.3[2] | 1.4[1] | 0.3[1)] |
| Test 2 | 4.6[3)] | 1.1[3)] | 6.0[4)] | 0.7[4)] | 1.5[3)] | 0.3[3)] |

[1)]0.2 MLux visible light/25 W * h/$m^2$ UVA light,
[2]0.2 MLux visible light without UVA light,
[3)]1.2 MLux visible light/173 W * h/$m^2$,
[4)]1.2 MLux visible light/30 W * h/$m^2$ Overall chemical modifications upon light exposure were least pronounced for CD33 cc-scFc. Especially deamidations of the CDRs were formed to a higher extent in CD3 cc-hALB and CD33 cc-hFc. When comparing Fc based constructs it was revealed that CD33 cc-scFc was less prone to chemical modifications of the Fc portion although the scFc construct was exposed to higher UVA light doses than the hFc-construct. Table 24 also lists the most abundant chemical modifications of the albumin portion in CD33 cc-hALB demonstrating that the half-life extending portion of this construct was chemically more degraded than the Fc portions of CD33 cc-hFc and -scFc.

TABLE 24

Overview on chemical modifications in CD33cc-hALB, –hFc, and scFc preparations determined after light exposure via peptide mapping

| Construct | hALB | | hFc | | scFc | |
|---|---|---|---|---|---|---|
| Formulation | K60RTrT | G40MSuT | K60RTrT | G40MSuT | K60RTrT | G40MSuT |
| % M34 oxidation (CDR) | | | | | | |
| T0 | 1.0 | 1.8 | 1.0 | 1.4 | 1.7 | 1.9 |
| Test 1 | 1.5[1)] | n.t. | 0.7[2)] | 4.2[2)] | 1.4[1)] | 1.2[1)] |
| Test 2 | 1.7[3)] | n.t. | 1.1[4)] | 4.2[4)] | 1.3[3)] | 1.7[3)] |
| % D103 isomerization (CDR) | | | | | | |
| T0 | 0.8 | 0.8 | 0.8 | 0.8 | 0.6 | 0.6 |
| Test 1 | 0.8[1)] | n.t. | 0.9[2)] | 0.9[2)] | 0.8[1)] | 1.0[1)] |
| Test 2 | 1.1[3)] | n.t. | 1.2[4)] | 1.4[4)] | 1.0[3)] | 1.3[3)] |
| % M290 oxidation (CDR) | | | | | | |
| T0 | 0.7 | 1.4 | 0.8 | 1 | 1.3 | 1.4 |
| Test 1 | 1.1[1)] | n.t. | 0.5[2)] | 3.3[2)] | 1.0[1)] | 0.9[1)] |
| Test 2 | 1.4[3)] | n.t. | 1.1[4)] | 4.2[4)] | 1.0[3)] | 1.4[3)] |
| % N359 deamidation (CDR) | | | | | | |
| T0 | 5.8 | 11.4 | 5.3 | 6.3 | 0.4 | 0.5 |
| Test 1 | 10.8[1)] | n.t. | 4.5[2)] | 5.6[2)] | 0.4[1)] | 0.2[1)] |
| Test 2 | 12.4[3)] | n.t. | 10.3[4)] | 3.6[4)] | 0.6[3)] | 0.2[3)] |
| % N362 deamidation (CDR) | | | | | | |
| T0 | 5.4 | 8.7 | 3.9 | 4.0 | 0.2 | 0.3 |
| Test 1 | 8.8[1)] | n.t. | 3.4[2)] | 3.5[2)] | 0.3[1)] | 0.3[1)] |
| Test 2 | 9.8[3)] | n.t. | 6.4[4)] | 2.3[4)] | 0.5[3)] | 0.3[3)] |
| % D510 isomerization (Fc) | | | | | | |
| T0 | n.a. | n.a. | 0.4 | 0.4 | 0.5 | 0.4 |
| Test 1 | n.a. | n.a. | 0.4[2)] | 0.6[2)] | 0.6[1)] | 0.5[1)] |
| Test 2 | n.a. | n.a. | 0.7[4)] | 0.7[4)] | 0.7[3)] | 0.7[3)] |
| % M541 oxidation (Fc) | | | | | | |
| T0 | n.a. | n.a. | 2.8 | 3 | 3.7 | 4.1 |
| Test 1 | n.a. | n.a. | 5.0[2)] | 0.7[2)] | 3.8[1)] | 3.8[1)] |
| Test 2 | n.a. | n.a. | 17.5[4)] | 18.4[4)] | 4.8[3)] | 5.5[3)] |
| % N614 deamidation (Fc) | | | | | | |
| T0 | n.a. | n.a. | 1.2 | 1.2 | 1.6 | 1.5 |
| Test 1 | n.a. | n.a. | 1.3[2)] | 1.7[2)] | 2.8[1)] | 2.2[1)] |
| Test 2 | n.a. | n.a. | 6.1[4)] | 1.9[4)] | 1.9[3)] | 2.3[3)] |

TABLE 24-continued

Overview on chemical modifications in CD33cc-hALB, -hFc, and scFc preparations determined after light exposure via peptide mapping

| Construct | hALB | | hFc | | scFc | |
|---|---|---|---|---|---|---|
| Formulation | K60RTrT | G40MSuT | K60RTrT | G40MSuT | K60RTrT | G40MSuT |
| % N673 deamidation (Fc) | | | | | | |
| T0 | n.a. | n.a. | 0.3 | 0.3 | 0.0 | 0.0 |
| Test 1 | n.a. | n.a. | 0.5[2)] | 0.6[2)] | 0.5[1)] | 0.6[1)] |
| Test 2 | n.a. | n.a. | 0.5[4)] | 0.6[4)] | 0.5[3)] | 1.5[3)] |
| % M717 oxidation (Fc) | | | | | | |
| T0 | n.a. | n.a. | 2.1 | 2.4 | 2.5 | 2.8 |
| Test 1 | n.a. | n.a. | 4.1[2)] | 7.3[2)] | 2.2[1)] | 2.3[1)] |
| Test 2 | n.a. | n.a. | 13.7[4)] | 13.5[4)] | 2.8[3)] | 3.8[3)] |
| % M598 oxidation (hALB) | | | | | | |
| T0 | 1.0 | n.t. | n.a. | n.a. | n.a. | n.a. |
| Test 1 | 2.3[1)] | n.t. | n.a. | n.a. | n.a. | n.a. |
| Test 2 | 6.4[3)] | n.t. | n.a. | n.a. | n.a. | n.a. |
| % M809 oxidation (hALB) | | | | | | |
| T0 | 1.8 | n.t. | n.a. | n.a. | n.a. | n.a. |
| Test 1 | 3.5[1)] | n.t. | n.a. | n.a. | n.a. | n.a. |
| Test 2 | 8.3[3)] | n.t. | n.a. | n.a. | n.a. | n.a. |
| % M840 oxidation (hALB) | | | | | | |
| T0 | 12.8 | n.t. | n.a. | n.a. | n.a. | n.a. |
| Test 1 | 32.0[1)] | n.t. | n.a. | n.a. | n.a. | n.a. |
| Test 2 | 61.7 | n.t. | n.a. | n.a. | n.a. | n.a. |
| % K1036 glycation (hALB) | | | | | | |
| T0 | 10.1 | n.t. | n.a. | n.a. | n.a. | n.a. |
| Test 1 | 10.2[1)] | n.t. | n.a. | n.a. | n.a. | n.a. |
| Test 2 | 9.9[3)] | n.t. | n.a. | n.a. | n.a. | n.a. |

[1)] 0.2 MLux visible light/25 W * $h/m^2$ UVA light,
[2)] 0.2 MLux visible light without UVA light,
[3)] 1.2 MLux visible light/173 W * $h/m^2$,
[4)] 1.2 MLux visible light/30 W * $h/m^2$

Example 14

Different BiTE® antibody constructs designed for targeting EGFRvIII including EGFRvIII-non half-life extended (non HLE, canonical), EGFRvIII-hALB, and EGFRvIII-scFc were examined. The target protein concentration was 1.0 mg/mL for the hALB and scFc and 0.4 mg/mL for the non HLE version. Formulated BiTE® antibody constructs were filled to 1 mL in type I glass vials which were stoppered with butyl rubber stoppers and crimped with aluminum seals. Filled vials were incubated at −20° C. and 37° C. (w/o and with 25 ppm silicon which is known for its potential to induce aggregation of proteins) for 4 weeks. Above constructs were also exposed to light (1.2 MLux visible light/173 W*h/m2 UVA light). For light stress, chamber temperature was set to 25° C. Samples stored at −70° C. served as controls (TO).

The samples described above were analyzed in duplicates by size exclusion ultra-high performance chromatography (SE-UPLC) in order to quantify the percentaged content of high molecular weight species (HMWS). SE-UPLC was performed on an Aquity H-Class UPLC system (Waters) using an Acquity UPLC BEH200 SEC 150 mm column (Waters). Column temperature was set to 25° C. Separation of size variants was achieved by applying an isocratic method with a flow rate of 0.4 mL/min. The mobile phase was composed of 100 mM sodium phosphate, 250 mM NaCl pH 6.8. The run time totals 6.0 minutes. Samples were held at 8° C. within the autosampler until analysis. A total amount of 3 μg protein was injected. In order to avoid carry over an intermediate injection with 40% ACN was performed after each sample. Detection was based on fluorescence (excitation at 280 nm, emission at 325 nm). Peak integration was performed using Empower® software. Relative area under the curve of HMWS was reported (Table 25).

Within non-stressed samples, HMWS were least pronounced for the scFc-construct. HMWS formation was exclusively observed during 4 weeks storage at −20° C. The HMWS contents under these conditions increase in the following order scFc <hALB <non HLE.

TABLE 25

Overview on HMWS contents in stressed and unstressed (T0) EGFRvIII-non HLE, -hALB, and -scFc preparations determined via SE-UPLC.

| Construct | Non HLE (canonical) | hALB | scFc |
|---|---|---|---|
| T0 | 1.3% | 1.3% | 1.0% |
| 4 w −20° C. | 4.6% | 1.8% | 1.6% |
| 4 w 37° C. | 0.9% | 0.6% | 0.5% |
| 4 w 37° C. (25 ppm silicon) | 1.1% | 0.8% | 0.8% |
| Light exposure | 1.0% | 0.9% | 0.5% |

Additionally, samples derived from heat stress in absence and presence of silicon were assessed for the abundance of subvisible particles by Microfluid Imaging (MFI) using a Flowcam from Fluid Imaging Technologies, Inc. The instrument was equipped with a FC80FV flow cell. A tenfold optical magnification was applied. System suitability was verified with particle free water. An autoimage rate of 20 frames per second was applied. Dark and light thresholds were set to 25 and 20 pixels respectively. Sample volume for a single measurement totals 0.25 mL. Samples were measured in triplicates. Prior to each triplicate the system was flushed of 0.5 mL of the respective sample solutions. At the beginning and between each triplicate a wash with 1.0 mL particle free water was performed. Data evaluation was performed with Visual Spreadsheet software. Samples were measured in triplicates. Results are outlined in Table 26.

Heat stress resulted in subvisible particle formation in preparations containing non HLE and hALB constructs. In contrast, the scFc construct remained stable. Subvisible particle formation was not promoted by the addition of silicon independent on the nature of the BiTE® antibody construct.

TABLE 26

Assessment of subvisible particles by MFI in EGFRvIII-non HLE (canonical), -hALB, and -scFc preparations after heat stress in absence and presence of silicon.

| Construct | Non HLE (canonical) | | | | hALB | | | | scFc | | | |
|---|---|---|---|---|---|---|---|---|---|---|---|---|
| Particle size [μm] | ≥2 | ≥5 | ≥10 | ≥25 | ≥2 | ≥5 | ≥10 | ≥25 | ≥2 | ≥5 | ≥10 | ≥25 |
| T0 | 146 | 35 | 12 | 0 | 281 | 71 | 35 | 0 | 298 | 150 | 33 | 0 |
| 4w 37° C. | 410 | 163 | 23 | 0 | 742 | 225 | 11 | 0 | 110 | 44 | 0 | 0 |
| 4w 37° C. (25 ppm silicon) | 69 | 35 | 11 | 0 | 272 | 91 | 34 | 0 | 146 | 55 | 11 | 0 |

Samples from heat stress were also analyzed by Weak Cation Exchange (WCX) chromatography in order to quantify the percentaged content of charge variants using a UPLC Aquity H class from Waters. A Protein-Pak Hi Res CM 71m 4.6×100 mm column (Waters, cat No. 186004929) was applied. The column temperature was adjusted to 30° C. The flow rate was set to 0.65 mL/min. The applied gradient was designed as follows (Table 27). The temperature of the autosampler was kept at 2-8° C.

TABLE 27

Gradient applied for WCX chromatography

| Time [min:sec] | % A 20 mM sodium phosphate, pH 6.5 | % B 20 mM sodium phosphate, 250 mM sodium chloride, pH 6.5 |
|---|---|---|
| 00:00 | 100 | 0 |
| 04:00 | 100 | 0 |
| 25:00 | 50 | 50 |
| 25:01 | 0 | 100 |
| 29:00 | 0 | 100 |
| 29:01 | 100 | 0 |

TABLE 27-continued

Gradient applied for WCX chromatography

| Time [min:sec] | % A 20 mM sodium phosphate, pH 6.5 | % B 20 mM sodium phosphate, 250 mM sodium chloride, pH 6.5 |
|---|---|---|
| 33:00 | 100 | 0 |

A total amount of 3 μg of protein was injected. Detection was based on fluorescence (excitation at 280 nm, emission at 325 nm). Peak integration was performed using Empower® software. Relative areas under the curve of the main peak as well as of acidic and basic charge variants was reported (Table 28).

Heat stress resulted in a reduced main peak percentage which had to be attributed to a predominant formation of acidic charge variants. The loss in main peak percentage was least pronounced for the scFc construct (7.5%). Basic charge variants were formed in both constructs with extended half-life upon light exposure. The increase in basic charge variants ranged between 5 and 6% in hALB and scFc constructs.

TABLE 28

Assessment of charge variants by WCX chromatography in EGFRvIII-non HLE (canonical), -hALB, and -scFc preparations after heat and light induced stress.

| | Non HLE (canonical) | | | hALB | | | scFc | | |
|---|---|---|---|---|---|---|---|---|---|
| Construct Fraction | % main | % acidics | % basics | % main | % acidics | % basics | % main | % acidics | % basics |
| T0 | 89.9 | 3.6 | 6.5 | 83.3 | 0.7 | 16.0 | 74.5 | 3.4 | 22.1 |
| 4w 37° C. | 79.3 | 11.1 | 9.5 | 75.6 | 9.8 | 14.6 | 67.0 | 11.2 | 21.8 |

In addition, sample purity was quantified in heat and light stressed samples using a microfluidic capillary electrophoresis sodium dodecylsulphate (CE-SDS) assay based on the LabChip GXII system (Perkin Elmer). The sample denaturing solution was composed of the HT Protein Express Sample Buffer (provided by Perkin Elmer) supplemented with 34 mM dithiothreitol. Each sample was diluted 1:8 with the denaturing solution and heated up to 700C for 10 minutes together with the protein express ladder. 35 μL of water for injection (WFI) were added to 40 μL of the denatured sample. 120 μL WFI were added to 12 μL of the ladder. Samples, ladder, protein express wash buffer, gel dye and destain solution are transferred to the respective reservoirs. Samples are electrokinetically loaded from a microtiter plate onto the chip integrating the separation, staining, destaining, and detection of the protein and its size variants. The resulting electropherograms were evaluated and changes in purity were reported. An overview on the percentaged purity detected post stress is given by Table 29 and compared to unstressed samples (T0).

Higher purities were observed for hALB and scFc constructs if compared to the non HLE construct under all conditions. Slight decreases in purity if compared to T0 were detected for hALB and scFc constructs upon heat and light stress. The loss in purity after 4 weeks storage at 37° C. totals 8.4% for the hALB construct and 6.6% for the scFc constructs. The losses upon light exposure were comparable between hALB and scFc.

TABLE 29

Overview on percentaged purity in stressed and unstressed (T0) EGFRvIII-non HLE, -hALB, and -scFc preparations determined via LabChip GXII (Caliper).

| Construct | Non HLE (canonical) | hALB | scFc |
|---|---|---|---|
| T0 | 57.4 | 96.0 | 92.2 |
| 4 w 37° C. | 60.6 | 87.6 | 85.6 |
| Light exposure | 61.5 | 90.1 | 86.4 |

Example 15

Different BiTE® antibody constructs designed for targeting DLL3 including DLL3-hALB and DLL3-scFc were formulated, respectively. The target protein concentration was 1.0 mg/mL for both constructs. Formulated BiTE® antibody constructs were filled to 1 mL in type I glass vials which were stoppered with butyl rubber stoppers and crimped with aluminum seals. Filled vials were incubated at 37° C. (DLL3-hALB) and 40° C. (DLL3-scFc) for 4 weeks. Samples stored at −70° C. served as controls (TO). Samples were analyzed by SE-UPLC according to the method described under Example 13. Results are outlined in Table 30.

The scFc construct exhibited a reduced monomer loss (2.3%) upon heat stress if compared to the hALB construct (4.0%) although the incubation temperature was slightly higher.

TABLE 30

Overview on monomer peak percentage in stressed and unstressed (T0) DLL3-hALB and -scFc preparations determined via SE-UPLC.

| Construct | hALB | scFc |
|---|---|---|
| T0 | 97.6% | 99.8% |
| 4 w | 93.6% | 97.5% |

Example 16

Different BiTE® antibody constructs designed for targeting CD19 including CD19-Xbody and CD19-scFc were examined. The target protein concentration was 1.0 mg/mL. Formulated BiTE® antibody constructs were filled to 1 mL in type I glass vials which were stoppered with butyl rubber stoppers and crimped with aluminum seals. Filled vials were incubated at −20° C. and 37° C. for 4 weeks. Additionally, all samples were exposed to 1.2 MLux visible light and 173 W*h/$m^2$ UVA light. Chamber temperature was adjusted to 25° C. Samples stored at −70° C. served as controls (TO). Samples stored at −20 and −37° C. were analyzed by SE-UPLC according to the method described under Example 13. Results are outlined in Table 31.

The scFc construct preserved a higher monomer content when stored for four weeks at −20 and 37° C. respectively if compared to the Xbody.

TABLE 31

Overview on monomer contents in stressed and unstressed (T0) CD19-Xbody and -scFc preparations determined via SE-UPLC.

| Construct | Xbody | scFc |
|---|---|---|
| T0 | 100.0 | 98.8 |
| 4 w −20° C. | 97.1 | 97.9 |
| 4 w 37° C. | 94.5 | 95.7 |

Additionally, unstressed samples were assessed for the abundance of subvisible particles by Microfluid Imaging (MFI) using the method described under Example 13. Results are outlined in Table 32. The CD19-scFc preparation exhibited significantly lower amounts of subvisible particles if compared to the CD19-Xbody preparation. This applies to all included size fractions.

TABLE 32

Assessment of subvisible particles by MFI in unstressed CD19-Xbody and -scFc

| Construct | Xbody | | | | scFc | | | |
|---|---|---|---|---|---|---|---|---|
| Particle size [μm] | ≥2 | ≥5 | ≥10 | ≥25 | ≥2 | ≥5 | ≥10 | ≥25 |
| T0 | 2648 | 688 | 192 | 32 | 160 | 64 | 43 | 11 |

Samples from light stress were also analyzed by Weak Cation Exchange (WCX) chromatography in order to quantify the percentaged content of charge variants using a UPLC Aquity H class from Waters according to the method described under Example 13. Relative areas under the curve of the main peak as well as of acidic and basic charge variants was reported (Table 33).

The scFc construct showed enhanced stability against light exposure if compared to the Xbody indicated by a less pronounced loss in main peak which totaled 1.4% compared to 5.5% for the Xbody construct.

TABLE 33

Assessment of charge variants by WCX chromatography in CD19-Xbody and –scFc preparations after heat and light induced stress.

| | Xbody | | | scFc | | |
|---|---|---|---|---|---|---|
| Construct Fraction | % main | % acidics | % basics | % main | % acidics | % basics |
| T0 | 51.4 | 30.3 | 18.3 | 83.5 | 1.3 | 15.2 |
| Light exposure | 45.9 | 33.2 | 20.9 | 82.1 | 1.2 | 16.7 |

Example 17: Size Exclusion Chromatography of Bispecific scFc Variants

Figure 7:
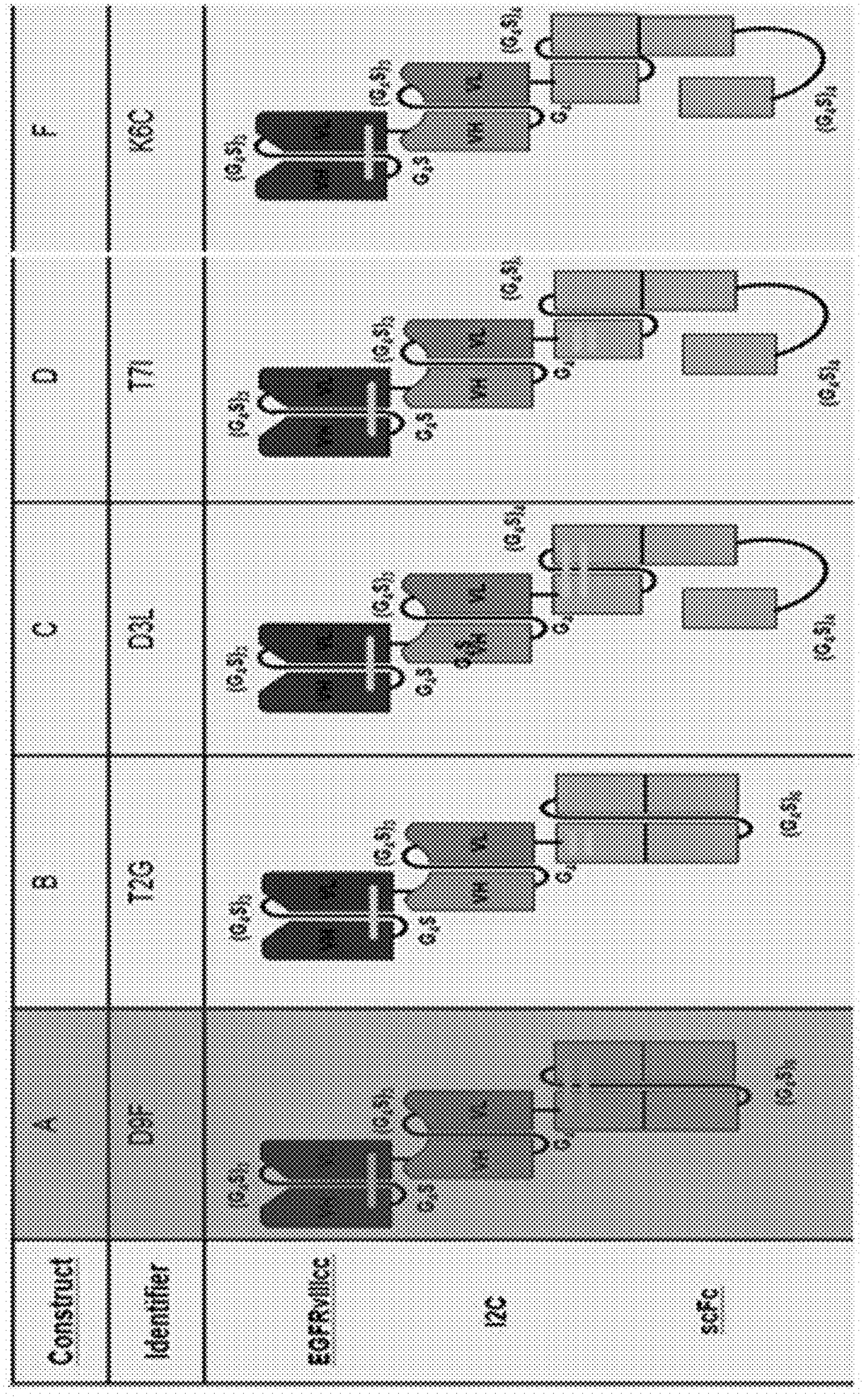
FIG. 7: Bispecific scFc variants D9F (SEQ ID NO: 1453), T2G (SEQ ID NO: 1454), D3L (SEQ ID NO: 1455), T7I (SEQ ID NO: 1456) and K6C (SEQ ID NO: 1457). A preferred antibody construct of the present invention is shown in SEQ ID NO: 1453.

The constructs D9F, T2G, D3L, T7I and K6C (see FIG. 7) were each tested for their running behavior by size exclusion chromatography according to standard procedures. In detail, a defined amount of 25 μg of each construct were run (at 750 μl/min) in Citrate Lysin Buffer (10 mM and 75 mM, pH7) on a Superdex 200 increase 10/300GL column at room temperature and the OD 280 nm was recorded. Subsequently, constructs have been compared by their retention times. As a result, construct D9F shows significantly delayed elution (Table 34) as compared to T2G, D3L, T7I and K6C, which indicates a difference in the structure/arrangement of the Fc domains. This difference in retention time was most significant with construct T7I having unpaired cysteines in the hinge region and the linkage of CH2 and CH2CH3 to CH3 (18.98 min vs. 18.62 min, difference of 0.36 min). However, also the difference in retention time of 0.16 min between D9F and T2G is significant taking the respective retention time of the BSA control into consideration. The BSA control showed a retention time of 19.07 min for the monomer and 16.82 min for the dimer displaying a difference of 2.25 min in retention time for a doubled molecular weight. Hence, as the constructs having only structural differences in the Fc part, 0.16 min difference in retention time are significant. In summary, construct D9F showed the longest retention time indicating the strongest binding. This conclusion leads to the expectation of D9F also has the longes half live in vivo.

TABLE 34

| Construct | Retention time in min |
|---|---|
| D9F | 18.98 |
| T2G | 18.82 |
| D3L | 18.78 |
| K6C | 18.77 |
| T7I | 18.62 |
| BSA monomer | 19.07 |
| BSA dimer | 16.82 |

Example 18: Surface Plasmon Resonance-Based Determination of Binding to Human FcRn (FCGRT/B2M)

The constructs D9F, T2G, D3L, T7I and K6C (FIG. 7) were each tested for their capability of binding against human FcRn in SPR (Biacore) experiments according to standard procedures. In detail, CM5 Sensor Chips (GE Healthcare) were immobilized with 450-500 RU of FCGRT/B2M (ACRO Biosystems) by using Na acetate buffer pH 4.5 and a running buffer consisting of 200 mM HEPES, 150 mM NaCl, 3 mM EDTA pH 6.0. The constructs were then injected in subsequent runs in two concentrations of 250 nM and 125 nM diluted in 200 mM HEPES, 150 mM NaCl, 3 mM EDTA, pH 6.0 and 36° C. Association was done for 90 seconds with a 30 μl/min flow rate followed by the dissociation phase for 90 seconds at a 30 μl/min flow rate in 200 mM HEPES, 150 mM NaCl, 3 mM EDTA, pH 6.0 at 36° C. Subsequent regeneration was done for 10 sec with 30 μl/min with 10 mM HEPES, 150 mM NaCl, 3 mM EDTA pH 7.4.

Figure 8A:
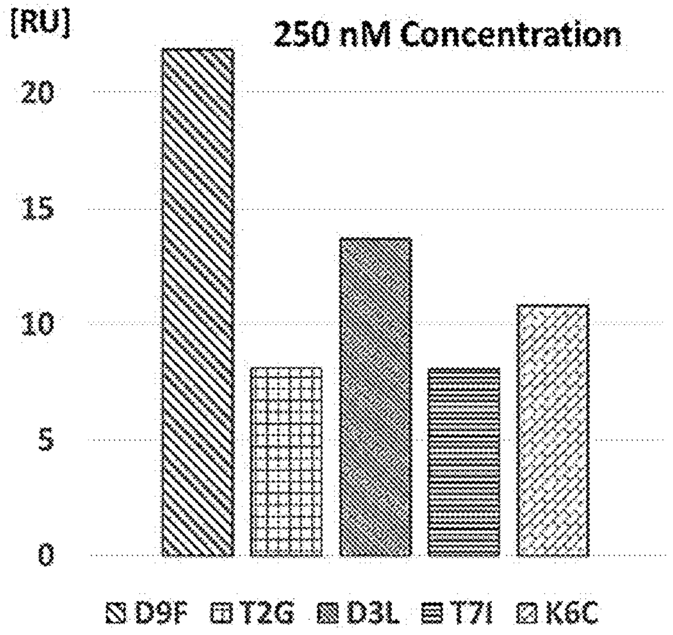
FIGS. 8A-8B: Surface Plasmon Resonance (SPR)-based determination of binding to human FcRn. Constructs D9F, T2G, D3L, T7I and K6C were each tested for their capability of binding against human FcRn in SPR (Biacore) experiments. The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted in FIGS. 8A and 8B.
Figure 8B:
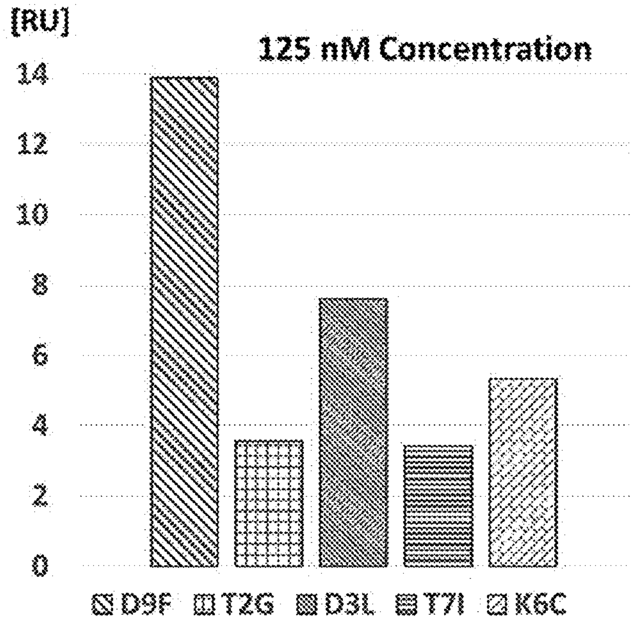

The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted in FIGS. 8A and 8B, respectively.

As a result, construct D9F shows significantly higher mass increase on the FcRn coated CM5 chip, as compared to T2G, D3L, T7I and K6C, which indicates stronger binding affinity of D9F to human FcRn. This observation was seen for both concentrations of the respective constructs.

The binding against FcRn is mediated through the Fc portion within the constructs. Stronger binding against human FcRn as described in the literature is an indicator for longer halflife in vivo due to a higher intracellular rescue of the respective protein and a therefore reduced degradation rate. For this reason, stronger binding of D9F to human FcRn as compared to the other constructs makes this molecule clearly superior as a basis for therapeutic molecules to allow for longer exposure of the potential drug in the patient and a lower frequency of drug administration.

Example 19: Surface Plasmon Resonance-Based Determination of Binding to Human FcRn (FCGRT/B2M)

The constructs D9F, T2G, D3L, T7I and K6C and a human IgG1-kappa antibody MT201 were each tested for their capability of binding against human FcRn in SPR (Biacore) experiments according to standard procedures. In detail, CM5 Sensor Chips (GE Healthcare) were immobilized with around 350 RU of FCGRT/B2M (ACRO Biosystems) by using Na acetate buffer pH 4.5 and a running buffer consisting of 200 mM HEPES, 150 mM NaCl, 3 mM EDTA pH 6.0. The constructs and the human IgG1-kappa control (MT201) were then injected at a concentration of 125 nM diluted in 200 mM HEPES, 150 mM NaCl, 3 mM EDTA, pH 6.0 and 36° C. Association was done for 90 seconds with a 30 μl/min flow rate followed by the dissociation phase for 60 seconds at a 30 μl/min flow rate in 200 mM HEPES, 150 mM NaCl, 3 mM EDTA, pH 6.0 at 36° C. Subsequent regeneration was done for 10 sec with 30 μl/min with 10 mM HEPES, 150 mM NaCl, 3 mM EDTA pH 7.4.

Figure 9:
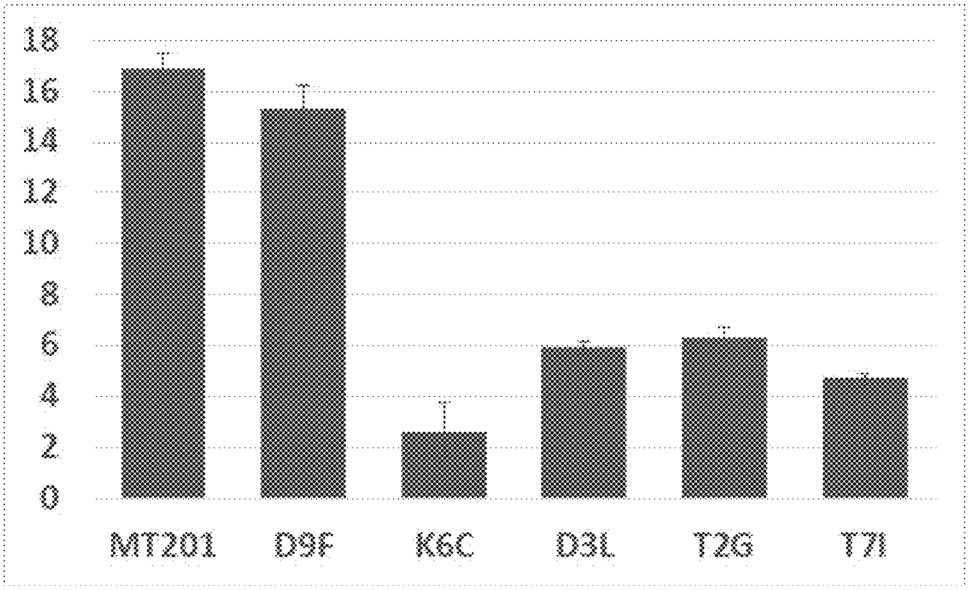
FIG. 9: The constructs D9F, T2G, D3L, T7I and K6C and a human IgG1-kappa antibody MT201 were each tested for their capability of binding against human FcRn in SPR (Biacore) experiments. The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted including standard deviation error bars.

The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted in FIG. 9 including standard deviation error bars.

As a result, construct D9F shows significantly higher mass increase on the FcRn coated CM5 chip, as compared to T2G, D3L, T7I and K6C, which indicates stronger binding affinity of D9F to human FcRn. The mass increase on the FcRn-coated CM5 chip for D9F is well comparable to the mass increase of the human IgG1-kappa control antibody MT201, indicating a comparable binding of construct D9F to human FcRn.

The binding against FcRn is mediated through the human IgG1 Fc portion within the constructs. Stronger binding against human FcRn as described in the field is an indicator for longer half-life in vivo due to a higher intracellular rescue of the respective protein and a therefore reduced degradation rate. For this reason, stronger binding of D9F to human FcRn in the range of a human IgG1-kappa antibody (MT201), as compared to the other constructs makes this molecule clearly superior as a basis for therapeutic molecules to allow for longer exposure of the potential drug in the patient, presumably in the range of a full human IgG1 antibody, and a lower frequency of drug administration.

TABLE 35

Sequence table

| SEQ ID NO: | Designation | Format/ Source | Sequence |
|---|---|---|---|
| 1. | G4S linker | | GGGGS |
| 2. | (G4S)2 linker | | GGGGSGGGGS |
| 3. | (G4S)3 linker | | GGGGSGGGGSGGGGS |
| 4. | (G4S)4 linker | | GGGGSGGGGSGGGGSGGGGS |
| 5. | (G4S)5 linker | | GGGGSGGGGSGGGGSGGGGSGGGGS |
| 6. | (G4S)6 linker | | GGGGSGGGGSGGGGSGGGGSGGGGSGGGGS |
| 7. | (G4S)7 linker | | GGGGSGGGGSGGGGSGGGGSGGGGSGGGGSGGGGS |
| 8. | (G4S)8 linker | | GGGGSGGGGSGGGGSGGGGSGGGGSGGGGSGGGGSGGGGS |
| 9. | Peptide linker | | PGGGGS |
| 10. | Peptide linker | | PGGDGS |
| 11. | Peptide linker | | SGGGGS |
| 12. | Peptide linker | | GGGG |
| 13. | CD3ϵ binder VL | | QTVVTQEPSLTVSPGGTVTLTCGSSTGAVTSGNYPNWVQQKPGQAPR<br>GLIGGTKFLAPGTPARFSGSLLGGKAALTLSGVQPEDEAEYYCVLWY<br>SNRWVFGGGTKLTVL |
| 14. | CD3ϵ binder VH | | EVQLVESGGGLVQPGGSLRLSCAASGFTFNSYAMNWVRQAPGKGLEW<br>VARIRSKYNNYATYYADSVKGRFTISRDDSKNTAYLQMNSLKTEDTA<br>VYYCVRHGNFGNSYVSWWAYWGQGTLVTVSS |
| 15. | CD3ϵ binder scFv | | EVQLVESGGGLVQPGGSLRLSCAASGFTFNSYAMNWVRQAPGKGLEW<br>VARIRSKYNNYATYYADSVKGRFTISRDDSKNTAYLQMNSLKTEDTA<br>VYYCVRHGNFGNSYVSWWAYWGQGTLVTVSSGGGGSGGGGSGGGGSQ<br>TVVTQEPSLTVSPGGTVTLTCGSSTGAVTSGNYPNWVQQKPGQAPRG<br>LIGGTKFLAPGTPARFSGSLLGGKAALTLSGVQPEDEAEYYCVLWYS<br>NRWVFGGGTKLTVL |
| 16. | hexa-histidine tag | | HHHHHH |
| 17. | Fc monomer-1 +c/-g | | DKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGK |
| 18. | Fc monomer-2 +c/-g/delGK | | DKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSP |
| 19. | Fc monomer-3 -c/+g | | DKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGK |

TABLE 35-continued

Sequence table

| SEQ ID NO: | Designation | Format/ Source | Sequence |
|---|---|---|---|
| 20. | Fc monomer-4<br>-c/+g/delGK | | DKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSP |
| 21. | Fc monomer-5<br>-c/-g | | DKTHTCPPCPAPELLGGPSVFLFPPKPKDTLMISRTPEVTCVVVDVS<br>HEDPEVKFNWYVDGVEVHNAKTKPREEQYGSTYRVVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGK |
| 22. | Fc monomer-6<br>-c/-g/delGK | | DKTHTCPPCPAPELLGGPSVFLFPPKPKDTLMISRTPEVTCVVVDVS<br>HEDPEVKFNWYVDGVEVHNAKTKPREEQYGSTYRVVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSP |
| 23. | Fc monomer-7<br>+c/+g | | DKTHTCPPCPAPELLGGPSVFLFPPKPKDTLMISRTPEVTCVVVDVS<br>HEDPEVKFNWYVDGVEVHNAKTKPCEEQYNSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGK |
| 24. | Fc monomer-8<br>+c/+g/delGK | | DKTHTCPPCPAPELLGGPSVFLFPPKPKDTLMISRTPEVTCVVVDVS<br>HEDPEVKFNWYVDGVEVHNAKTKPCEEQYNSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSP |
| 25. | scFc-1 | | DKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGKGGGGSGGG<br>GSGGGGSGGGGSGGGGSGGGGSDKTHTCPPCPAPELLGGPSVFLFPP<br>KPKDTLMISRTPEVTCVVVDVSHEDPEVKFNWYVDGVEVHNAKTKPC<br>EEQYGSTYRCVSVLTVLHQDWLNGKEYKCKVSNKALPAPIEKTISKA<br>KGQPREPQVYTLPPSREEMTKNQVSLTCLVKGFYPSDIAVEWESNGQ<br>PENNYKTTPPVLDSDGSFFLYSKLTVDKSRWQQGNVFSCSVMHEALH<br>NHYTQKSLSLSPGK |
| 26. | scFc-2 | | DKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGGGGSGGGGS<br>GGGGSGGGGSGGGGSGGGGSDKTHTCPPCPAPELLGGPSVFLFPPKP<br>KDTLMISRTPEVTCVVVDVSHEDPEVKFNWYVDGVEVHNAKTKPCEE<br>QYGSTYRCVSVLTVLHQDWLNGKEYKCKVSNKALPAPIEKTISKAKG<br>QPREPQVYTLPPSREEMTKNQVSLTCLVKGFYPSDIAVEWESNGQPE<br>NNYKTTPPVLDSDGSFFLYSKLTVDKSRWQQGNVFSCSVMHEALHNH<br>YTQKSLSLSP |
| 27. | scFc-3 | | DKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGKGGGGSGGG<br>GSGGGGSGGGGSGGGGSGGGGSDKTHTCPPCPAPELLGGPSVFLFPP<br>KPKDTLMISRTPEVTCVVVDVSHEDPEVKFNWYVDGVEVHNAKTKPR<br>EEQYNSTYRVVSVLTVLHQDWLNGKEYKCKVSNKALPAPIEKTISKA<br>KGQPREPQVYTLPPSREEMTKNQVSLTCLVKGFYPSDIAVEWESNGQ<br>PENNYKTTPPVLDSDGSFFLYSKLTVDKSRWQQGNVFSCSVMHEALH<br>NHYTQKSLSLSPGK |
| 28. | scFc-4 | | DKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKN<br>QVSLTCLVKGFYPSDIAVEWESNGQPENNYKTTPPVLDSDGSFFLYS<br>KLTVDKSRWQQGNVFSCSVMHEALHNHYTQKSLSLSPGGGGSGGGGS<br>GGGGSGGGGSGGGGSGGGGSDKTHTCPPCPAPELLGGPSVFLFPPKP<br>KDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKG |

TABLE 35-continued

| Sequence table | | | |
|---|---|---|---|
| SEQ ID NO: | Designation | Format/ Source | Sequence |
| | | | QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 29. | scFc-5 | | DKTHTCPPCPAPELLGGPSVFLFPPKPKDTLMISRTPEVTCVVVDVS HEDPEVKFNWYVDGVEVHNAKTKPREEQYGSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGKGGGGSGGG GSGGGGSGGGGSGGGGSGGGGSDKTHTCPPCPAPELLGGPSVFLFPP KPKDTLMISRTPEVTCVVVDVSHEDPEVKFNWYVDGVEVHNAKTKPR EEQYGSTYRVVSVLTVLHQDWLNGKEYKCKVSNKALPAPIEKTISKA KGQPREPQVYTLPPSREEMTKNQVSLTCLVKGFYPSDIAVEWESNGQ PENNYKTTPPVLDSDGSFFLYSKLTVDKSRWQQGNVFSCSVMHEALH NHYTQKSLSLSPGK |
| 30. | scFc-6 | | DKTHTCPPCPAPELLGGPSVFLFPPKPKDTLMISRTPEVTCVVVDVS HEDPEVKFNWYVDGVEVHNAKTKPREEQYGSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKP KDTLMISRTPEVTCVVVDVSHEDPEVKFNWYVDGVEVHNAKTKPREE QYGSTYRVVSVLTVLHQDWLNGKEYKCKVSNKALPAPIEKTISKAKG QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 31. | scFc-7 | | DKTHTCPPCPAPELLGGPSVFLFPPKPKDTLMISRTPEVTCVVVDVS HEDPEVKFNWYVDGVEVHNAKTKPCEEQYNSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGKGGGGSGGG GSGGGGSGGGGSGGGGSGGGGSDKTHTCPPCPAPELLGGPSVFLFPP KPKDTLMISRTPEVTCVVVDVSHEDPEVKFNWYVDGVEVHNAKTKPC EEQYNSTYRCVSVLTVLHQDWLNGKEYKCKVSNKALPAPIEKTISKA KGQPREPQVYTLPPSREEMTKNQVSLTCLVKGFYPSDIAVEWESNGQ PENNYKTTPPVLDSDGSFFLYSKLTVDKSRWQQGNVFSCSVMHEALH NHYTQKSLSLSPGK |
| 32. | scFc-8 | | DKTHTCPPCPAPELLGGPSVFLFPPKPKDTLMISRTPEVTCVVVDVS HEDPEVKFNWYVDGVEVHNAKTKPCEEQYNSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKP KDTLMISRTPEVTCVVVDVSHEDPEVKFNWYVDGVEVHNAKTKPCEE QYNSTYRCVSVLTVLHQDWLNGKEYKCKVSNKALPAPIEKTISKAKG QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 33. | MSLN-HLE | Hetero Fc chain 1 | QVQLVESGGGLVKPGGSLRLSCAASGFTFSDYYMTWIRQAPGKGLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGQGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSRKEMTKNQVSLTCLVKGFYPSDIAVE WESNGQPENNYKTTPPVLKSDGSFFLYSKLTVDKSRWQQGNVFSCSV MHEALHNHYTQKSLSLSPGK |
| 34. | MSLN-HLE | Hetero Fc chain 2 | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYDTTPPVLDSDGSFFLYS DLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 35. | MSLN-HLE | hALB fusion | QVQLVESGGGLVKPGGSLRLSCAASGFTFSDYYMTWIRQAPGKGLEW<br>LSYISSSGSTIYYADSVKGRFTISRDNAKNSLFLQMNSLRAEDTAVY<br>YCARDRNSHFDYWGQGTLVTVSSGGGGSGGGGSGGGGSDIQMTQSPS<br>SVSASVGDRVTITCRASQGINTWLAWYQQKPGKAPKLLIYGASGLQS<br>GVPSRFSGSGSGTDFTLTISSLQPEDFATYYCQQAKSFPRTFGQGTK<br>VEIKSGGGGSEVQLVESGGGLVQPGGSLKLSCAASGFTFNKYAMNWV<br>RQAPGKGLEWVARIRSKYNNYATYYADSVKDRFTISRDDSKNTAYLQ<br>MNNLKTEDTAVYYCVRHGNFGNSYISYWAYWGQGTLVTVSSGGGGSG<br>GGGSGGGGSQTVVTQEPSLTVSPGGTVTLTCGSSTGAVTSGNYPNWV<br>QQKPGQAPRGLIGGTKFLAPGTPARFSGSLLGGKAALTLSGVQPEDE<br>AEYYCVLWYSNRWVFGGGTKLTVLPGGDGSDAHKSEVAHRFKDLGEE<br>NFKALVLIAFAQYLQQCPFEDHVKLVNEVTEFAKTCVADESAENCDK<br>SLHTLFGDKLCTVATLRETYGEMADCCAKQEPERNECFLQHKDDNPN<br>LPRLVRPEVDVMCTAFHDNEETFLKKYLYEIARRHPYFYAPELLFFA<br>KRYKAAFTECCQAADKAACLLPKLDELRDEGKASSAKQRLKCASLQK<br>FGERAFKAWAVARLSQRFPKAEFAEVSKLVTDLTKVHTECCHGDLLE<br>CADDRADLAKYICENQDSISSKLKECCEKPLLEKSHCIAEVENDEMP<br>ADLPSLAADFVESKDVCKNYAEAKDVFLGMFLYEYARRHPDYSVVLL<br>LRLAKTYETTLEKCCAAADPHECYAKVFDEFKPLVEEPQNLIKQNCE<br>LFEQLGEYKFQNALLVRYTKKVPQVSTPTLVEVSRNLGKVGSKCCKH<br>PEAKRMPCAEDYLSVVLNQLCVLHEKTPVSDRVTKCCTESLVNRRPC<br>FSALEVDETYVPKEFNAETFTFHADICTLSEKERQIKKQTALVELVK<br>HKPKATKEQLKAVMDDFAAFVEKCCKADDKETCFAEEGKKLVAASQA<br>ALGLHHHHHH |
| 36. | CDH19-HLEa | X-body chain 1 | EVQLVESGGGLVQPGGSLKLSCAASGFTFNKYAMNWVRQAPGKGLEW<br>VARIRSKYNNYATYYADSVKDRFTISRDDSKNTAYLQMNNLKTEDTA<br>VYYCVRHGNFGNSYISYWAYWGQGTLVTVSSGGGGSGGGGSSYELTQ<br>PPSVSVSPGQTASITCSGDRLGEKYTSWYQQRPGQSPLLVIYQDTKR<br>PSGIPERFSGSNSGNTATLTISGTQAMDEADYYCQAWESSTVVFGGG<br>TKLTVLASTKGPSVFPLAPSSKSTSGGTAALGCLVKDYFPEPVTVSW<br>NSGALTSGVHTFPAVLQSSGLYSLSSVVTVPSSSLGTQTYICNVNHK<br>PSNTKVDKKVEPKSCDKTHTCPPCPAPELLGGPSVFLFPPKPKDTLM<br>ISRTPEVTCVVVDVSHEDPEVKFNWYVDGVEVHNAKTKPCEEQYGST<br>YRCVSVLTVLHQDWLNGKEYKCKVSNKALPAPIEKTISKAKGQPREP<br>QVYTLPPSREEMTKNQVSLTCLVKGFYPSDIAVEWESNGQPENNYDT<br>TPPVLDSDGSFFLYSDLTVDKSRWQQGNVFSCSVMHEALHNHYTQKS<br>LSLSPGK |
| 37. | CDH19-HLEb | X-body chain 2 | QVQLVESGGGVVQPGGSLRLSCAASGFTFSSYGMHWVRQAPGKGLEW<br>VAFIWYEGSNKYYAESVKDRFTISRDNSKNTLYLQMNSLRAEDTAVY<br>YCARRAGIIGTIGYYYGMDVWGQGTTVTVSSGGGGSGGGGSQTVVTQ<br>EPSLTVSPGGTVTLTCGSSTGAVTSGNYPNWVQQKPGQAPRGLIGGT<br>KFLAPGTPARFSGSLLGGKAALTLSGVQPEDEAEYYCVLWYSNRWVF<br>GGGTKLTVLGQPKAAPSVTLFPPSSEELQANKATLVCLISDFYPGAV<br>TVAWKADSSPVKAGVETTTPSKQSNNKYAASSYLSLTPEQWKSHRSY<br>SCQVTHEGSTVEKTVAPTECSDKTHTCPPCPAPELLGGPSVFLFPPK<br>PKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAK<br>GQPREPQVYTLPPSRKEMTKNQVSLTCLVKGFYPSDIAVEWESNGQP<br>ENNYKTTPPVLKSDGSFFLYSKLTVDKSRWQQGNVFSCSVMHEALHN<br>HYTQKSLSLSPGK |
| 38. | CDH19-HLE | Hetero Fc chain 1 | QVQLVESGGGVVQPGGSLRLSCAASGFTFSSYGMHWVRQAPGKGLEW<br>VAFIWYEGSNKYYAESVKDRFTISRDNSKNTLYLQMNSLRAEDTAVY<br>YCARRAGIIGTIGYYYGMDVWGQGTTVTVSSGGGGSGGGGSGGGGSS<br>YELTQPPSVSVSPGQTASITCSGDRLGEKYTSWYQQRPGQSPLLVIY<br>QDTKRPSGIPERFSGSNSGNTATLTISGTQAMDEADYYCQAWESSTV<br>VFGGGTKLTVLSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSRKEMTKNQVSLTCLVKGFY<br>PSDIAVEWESNGQPENNYKTTPPVLKSDGSFFLYSKLTVDKSRWQQG<br>NVFSCSVMHEALHNHYTQKSLSLSPGK |
| 39. | CDH19-HLE | Hetero Fc chain 2 | DKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYDTTPPVLDSDGSFFLYS<br>DLTVDKSRWQQGNVFSCSVMHEALHNHYTQKSLSLSPGK |

TABLE 35-continued

Sequence table

| SEQ ID NO: | Designation | Format/ Source | Sequence |
|---|---|---|---|
| 40. | CD33-HLE | Hetero Fc chain 1 | QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK |
| 41. | CD33-HLE | Hetero Fc chain 2 | DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK |
| 42. | CD33-HLE | scFc | QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 43. | CD20-HLE | scFc | QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 44. | CD33xI2C-scFc | VH CDR1 | NYGMN |
| 45. | CD33xI2C-scFc | VH CDR2 | WINTYTGEPTYADKFQG |

TABLE 35-continued

| Sequence table | | | |
|---|---|---|---|
| SEQ ID NO: | Designation | Format/ Source | Sequence |
| 46. | CD33xI2C-scFc | VH CDR3 | WSWSDGYYVYFDY |
| 47. | CD33xI2C-scFc | VL CDR1 | KSSQSVLDSSTNKNSLA |
| 48. | CD33xI2C-scFc | VL CDR2 | WASTRES |
| 49. | CD33xI2C-scFc | VL CDR3 | QQSAHFPIT |
| 50. | CD33xI2C-scFc | VH | QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSS |
| 51. | CD33xI2C-scFc | VL | DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK |
| 52. | CD33xI2C-scFc | scFv | QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK |
| 53. | CD33xI2C-scFc | Bispecific molecule | QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 54. | CD33xI2C-scFc | Bispecific HLE molecule | QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 55. | CD33xI2C-scFc_delGK | Bispecific HLE molecule | QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKF |

TABLE 35-continued

Sequence table

| SEQ ID NO: | Designation | Format/ Source | Sequence |
|---|---|---|---|
| | | | NWYVDGVEVHNAKTKPCEEQYGSTYRCVSVLTVLHQDWLNGKEYKCK VSNKALPAPIEKTISKAKGQPREPQVYTLPPSREEMTKNQVSLTCLV KGFYPSDIAVEWESNGQPENNYKTTPPVLDSDGSFFLYSKLTVDKSR WQQGNVFSCSVMHEALHNHYTQKSLSLSPGGGGSGGGGSGGGGSGGG GSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRC VSVLTVLHQDWLNGKEYKCKVSNKALPAPIEKTISKAKGQPREPQVY TLPPSREEMTKNQVSLTCLVKGFYPSDIAVEWESNGQPENNYKTTPP VLDSDGSFFLYSKLTVDKSRWQQGNVFSCSVMHEALHNHYTQKSLSL SPGK |
| 56. | CD33_CCxI2C -scFc | VH | QVQLVQSGAEVKKPGESVKVSCKASGYTFTNYGMNWVKQAPGQCLEW MGWINTYTGEPTYADKFQGRVTMTTDTSTSTAYMEIRNLGGDDTAVY YCARWSWSDGYYVYFDYWGQGTSVTVSS |
| 57. | CD33_CCxI2C -scFc | VL | DIVMTQSPDSLTVSLGERTTINCKSSQSVLDSSTNKNSLAWYQQKPG QPPKLLLSWASTRESGIPDRFSGSGSGTDFTLTIDSPQPEDSATYYC QQSAHFPITFGCGTRLEIK |
| 58. | CD33_CCxI2C -scFc | scFv | QVQLVQSGAEVKKPGESVKVSCKASGYTFTNYGMNWVKQAPGQCLEW MGWINTYTGEPTYADKFQGRVTMTTDTSTSTAYMEIRNLGGDDTAVY YCARWSWSDGYYVYFDYWGQGTSVTVSSGGGGSGGGGSGGGGSDIVM TQSPDSLTVSLGERTTINCKSSQSVLDSSTNKNSLAWYQQKPGQPPK LLLSWASTRESGIPDRFSGSGSGTDFTLTIDSPQPEDSATYYCQQSA HFPITFGCGTRLEIK |
| 59. | CD33_CCxI2C | Bispecific molecule | QVQLVQSGAEVKKPGESVKVSCKASGYTFTNYGMNWVKQAPGQCLEW MGWINTYTGEPTYADKFQGRVTMTTDTSTSTAYMEIRNLGGDDTAVY YCARWSWSDGYYVYFDYWGQGTSVTVSSGGGGSGGGGSGGGGSDIVM TQSPDSLTVSLGERTTINCKSSQSVLDSSTNKNSLAWYQQKPGQPPK LLLSWASTRESGIPDRFSGSGSGTDFTLTIDSPQPEDSATYYCQQSA HFPITFGCGTRLEIKSGGGGSEVQLVESGGGLVQPGGSLKLSCAASG FTFNKYAMNWVRQAPGKGLEWVARIRSKYNNYATYYADSVKDRFTIS RDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAA LTLSGVQPEDEAEYYCVLWYSNRWVFGGGTKLTVL |
| 60. | CD33_CCxI2C -scFc | Bispecific HLE molecule | QVQLVQSGAEVKKPGESVKVSCKASGYTFTNYGMNWVKQAPGQCLEW MGWINTYTGEPTYADKFQGRVTMTTDTSTSTAYMEIRNLGGDDTAVY YCARWSWSDGYYVYFDYWGQGTSVTVSSGGGGSGGGGSGGGGSDIVM TQSPDSLTVSLGERTTINCKSSQSVLDSSTNKNSLAWYQQKPGQPPK LLLSWASTRESGIPDRFSGSGSGTDFTLTIDSPQPEDSATYYCQQSA HFPITFGCGTRLEIKSGGGGSEVQLVESGGGLVQPGGSLKLSCAASG FTFNKYAMNWVRQAPGKGLEWVARIRSKYNNYATYYADSVKDRFTIS RDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAA LTLSGVQPEDEAEYYCVLWYSNRWVFGGGTKLTVLGGGGDKTHTCPP CPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCK VSNKALPAPIEKTISKAKGQPREPQVYTLPPSREEMTKNQVSLTCLV KGFYPSDIAVEWESNGQPENNYKTTPPVLDSDGSFFLYSKLTVDKSR WQQGNVFSCSVMHEALHNHYTQKSLSLSPGKGGGGSGGGGSGGGGSG GGGSGGGGSGGGGSDKTHTCPPCPAPELLGGPSVFLFPPKPKDTLMI SRTPEVTCVVVDVSHEDPEVKFNWYVDGVEVHNAKTKPCEEQYGSTY RCVSVLTVLHQDWLNGKEYKCKVSNKALPAPIEKTISKAKGQPREPQ VYTLPPSREEMTKNQVSLTCLVKGFYPSDIAVEWESNGQPENNYKTT PPVLDSDGSFFLYSKLTVDKSRWQQGNVFSCSVMHEALHNHYTQKSL SLSPGK |
| 61. | CD33_CCxI2C -scFc_delGK | Bispecific HLE molecule | QVQLVQSGAEVKKPGESVKVSCKASGYTFTNYGMNWVKQAPGQCLEW MGWINTYTGEPTYADKFQGRVTMTTDTSTSTAYMEIRNLGGDDTAVY YCARWSWSDGYYVYFDYWGQGTSVTVSSGGGGSGGGGSGGGGSDIVM TQSPDSLTVSLGERTTINCKSSQSVLDSSTNKNSLAWYQQKPGQPPK LLLSWASTRESGIPDRFSGSGSGTDFTLTIDSPQPEDSATYYCQQSA HFPITFGCGTRLEIKSGGGGSEVQLVESGGGLVQPGGSLKLSCAASG FTFNKYAMNWVRQAPGKGLEWVARIRSKYNNYATYYADSVKDRFTIS RDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAA LTLSGVQPEDEAEYYCVLWYSNRWVFGGGTKLTVLGGGGDKTHTCPP CPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCK VSNKALPAPIEKTISKAKGQPREPQVYTLPPSREEMTKNQVSLTCLV |

TABLE 35-continued

Sequence table

| SEQ ID NO: | Designation | Format/ Source | Sequence |
|---|---|---|---|
| | | | KGFYPSDIAVEWESNGQPENNYKTTPPVLDSDGSFFLYSKLTVDKSR WQQGNVFSCSVMHEALHNHYTQKSLSLSPGGGGSGGGGSGGGGSGGG GSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRC VSVLTVLHQDWLNGKEYKCKVSNKALPAPIEKTISKAKGQPREPQVY TLPPSREEMTKNQVSLTCLVKGFYPSDIAVEWESNGQPENNYKTTPP VLDSDGSFFLYSKLTVDKSRWQQGNVFSCSVMHEALHNHYTQKSLSL SPGK |
| 62. | EGFRVIIIxCD3 -scFc | VH CDR1 | NYGMH |
| 63. | EGFRVIIIxCD3 -scFc | VH CDR2 | VIWYDGSDKYYADSVRG |
| 64. | EGFRVIIIxCD3 -scFc | VH CDR3 | DGYDILTGNPRDFDY |
| 65. | EGFRVIIIxCD3 -scFc | VL CDR1 | RSSQSLVHSDGNTYLS |
| 66. | EGFRVIIIxCD3 -scFc | VL CDR2 | RISRRFS |
| 67. | EGFRVIIIxCD3 -scFc | VL CDR3 | MQSTHVPRT |
| 68. | EGFRVIIIxCD3 -scFc | VH | QVQLVESGGGVVQSGRSLRLSCAASGFTFRNYGMHWVRQAPGKGLEW VAVIWYDGSDKYYADSVRGRFTISRDNSKNTLYLQMNSLRAEDTAVY YCARDGYDILTGNPRDFDYWGQGTLVTVSS |
| 69. | EGFRVIIIxCD3 -scFc | VL | DTVMTQTPLSSHVTLGQPASISCRSSQSLVHSDGNTYLSWLQQRPGQ PPRLLIYRISRRFSGVPDRFSGSGAGTDFTLEISRVEAEDVGVYYCM QSTHVPRTFGQGTKVEIK |
| 70. | EGFRVIIIxCD3 -scFc | scFv | QVQLVESGGGVVQSGRSLRLSCAASGFTFRNYGMHWVRQAPGKGLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGQGTKVEIK |
| 71. | EGFRvIIIxCD3 -scFc | Bispecific molecule | QVQLVESGGGVVQSGRSLRLSCAASGFTFRNYGMHWVRQAPGKGLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGQGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVL |
| 72. | EGFRvIIIxCD3 -scFc | Bispecific HLE molecule | QVQLVESGGGVVQSGRSLRLSCAASGFTFRNYGMHWVRQAPGKGLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGQGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGKGGGGSGGGGSGGGGS GGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGST YRCVSVLTVLHQDWLNGKEYKCKVSNKALPAPIEKTISKAKGQPREP |

TABLE 35-continued

| SEQ ID NO: | Designation | Format/ Source | Sequence |
|---|---|---|---|
| | | | QVYTLPPSREEMTKNQVSLTCLVKGFYPSDIAVEWESNGQPENNYKT TPPVLDSDGSFFLYSKLTVDKSRWQQGNVFSCSVMHEALHNHYTQKS LSLSPGK |
| 73. | EGFRvIIIxCD3 -scFc_delGK | Bispecific HLE molecule | QVQLVESGGGVVQSGRSLRLSCAASGFTFRNYGMHWVRQAPGKGLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGQGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGGGGSGGGGSGGGGSGG GGSGGGGSGGGGSDKTHTCPPCPAPELLGGPSVFLFPPKPKDTLMIS RTPEVTCVVVDVSHEDPEVKFNWYVDGVEVHNAKTKPCEEQYGSTYR CVSVLTVLHQDWLNGKEYKCKVSNKALPAPIEKTISKAKGQPREPQV YTLPPSREEMTKNQVSLTCLVKGFYPSDIAVEWESNGQPENNYKTTP PVLDSDGSFFLYSKLTVDKSRWQQGNVFSCSVMHEALHNHYTQKSLS LSPGK |
| 74. | EGFRvIII_CCx CD3-scFc | VH | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSS |
| 75. | EGFRvIII_CCx CD3-scFc | VL | DTVMTQTPLSSHVTLGQPASISCRSSQSLVHSDGNTYLSWLQQRPGQ PPRLLIYRISRRFSGVPDRFSGSGAGTDFTLEISRVEAEDVGVYYCM QSTHVPRTFGCGTKVEIK |
| 76. | EGFRvIII_CCx CD3-scFc | scFv | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIK |
| 77. | EGFRvIII_CCx CD3-scFc | Bispecific HLE molecule | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVL |
| 78. | EGFRvIII_CCx CD3-scFc | Bispecific HLE molecule | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGKGGGGSGGGGSGGGGS GGGGSGGGGSGGGGSDKTHTCPPCPAPELLGGPSVFLFPPKPKDTLM |

TABLE 35-continued

| Sequence table | | | |
|---|---|---|---|
| SEQ ID NO: | Designation | Format/ Source | Sequence |
| | | | ISRTPEVTCVVVDVSHEDPEVKFNWYVDGVEVHNAKTKPCEEQYGST YRCVSVLTVLHQDWLNGKEYKCKVSNKALPAPIEKTISKAKGQPREP QVYTLPPSREEMTKNQVSLTCLVKGFYPSDIAVEWESNGQPENNYKT TPPVLDSDGSFFLYSKLTVDKSRWQQGNVFSCSVMHEALHNHYTQKS LSLSPGK |
| 79. | EGFRvIII_CCx CD3- scFc_delGK | bispecific molecule | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGGGGSGGGGSGGGGSGG GGSGGGGSGGGGSDKTHTCPPCPAPELLGGPSVFLFPPKPKDTLMIS RTPEVTCVVVDVSHEDPEVKFNWYVDGVEVHNAKTKPCEEQYGSTYR CVSVLTVLHQDWLNGKEYKCKVSNKALPAPIEKTISKAKGQPREPQV YTLPPSREEMTKNQVSLTCLVKGFYPSDIAVEWESNGQPENNYKTTP PVLDSDGSFFLYSKLTVDKSRWQQGNVFSCSVMHEALHNHYTQKSLS LSPGK |
| 80. | MS_1xCD3- scFc | VH CDR1 | DYYMT |
| 81. | MS_1xCD3- scFc | VH CDR2 | YISSSGSTIYYADSVKG |
| 82. | MS_1xCD3- scFc | VH CDR3 | DRNSHFDY |
| 83. | MS_1xCD3- scFc | VL CDR1 | RASQGINTWLA |
| 84. | MS_1xCD3- scFc | VL CDR2 | GASGLQS |
| 85. | MS_1xCD3- scFc | VL CDR3 | QQAKSFPRT |
| 86. | MS_1xCD3- scFc | VH | QVQLVESGGGLVKPGGSLRLSCAASGFTFSDYYMTWIRQAPGKGLEW LSYISSSGSTIYYADSVKGRFTISRDNAKNSLFLQMNSLRAEDTAVY YCARDRNSHFDYWGQGTLVTVSS |
| 87. | MS_1xCD3- scFc | VL | DIQMTQSPSSVSASVGDRVTITCRASQGINTWLAWYQQKPGKAPKLL IYGASGLQSGVPSRFSGSGSGTDFTLTISSLQPEDFATYYCQQAKSF PRTFGQGTKVEIK |
| 88. | MS_1xCD3- scFc | scFv | QVQLVESGGGLVKPGGSLRLSCAASGFTFSDYYMTWIRQAPGKGLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGQGTK VEIK |
| 89. | MS_1xCD3- scFc | Bispecific molecule | QVQLVESGGGLVKPGGSLRLSCAASGFTFSDYYMTWIRQAPGKGLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGQGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVL |

TABLE 35-continued

| Sequence table | | | |
|---|---|---|---|
| SEQ ID NO: | Designation | Format/ Source | Sequence |
| 90. | MS_1xCD3-scFc | Bispecific HLE molecule | QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 91. | MS_1xCD3-scFc_delGK | Bispecific HLE molecule | QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 92. | MS_1_CCxCD3-scFc | VH | QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSS |
| 93. | MS_1_CCxCD3-scFc | VL | DIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIK |
| 94. | MS_1_CCxCD3-scFc | scFv | QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIK |
| 95. | MS_1_CCxCD3-scFc | Bispecific molecule | QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |

TABLE 35-continued

Sequence table

| SEQ ID NO: | Designation | Format/ Source | Sequence |
|---|---|---|---|
| 96. | MS_1_CCxCD 3-scFc | Bispecific HLE molecule | QVQLVESGGGLVKPGGSLRLSCAASGFTFSDYYMTWIRQAPGKCLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGCGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGKGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 97. | MSCCxCD 3-scFc_delGK | Bispecific HLE molecule | QVQLVESGGGLVKPGGSLRLSCAASGFTFSDYYMTWIRQAPGKCLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGCGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGGGGSGGGGSGGGGSGGGGSGGGGSGGGG SDKTHTCPPCPAPELLGGPSVFLFPPKPKDTLMISRTPEVTCVVVDV SHEDPEVKFNWYVDGVEVHNAKTKPCEEQYGSTYRCVSVLTVLHQDW LNGKEYKCKVSNKALPAPIEKTISKAKGQPREPQVYTLPPSREEMTK NQVSLTCLVKGFYPSDIAVEWESNGQPENNYKTTPPVLDSDGSFFLY SKLTVDKSRWQQGNVFSCSVMHEALHNHYTQKSLSLSPGK |
| 98. | MS_2xCD3- scFc | VH CDR1 | DYYMT |
| 99. | MS_2xCD3- scFc | VH CDR2 | YISSSGSTIYYADSVKG |
| 100. | MS_2xCD3- scFc | VH CDR3 | DRNSHFDY |
| 101. | MS_2xCD3- scFc | VL CDR1 | RASQGITRWLA |
| 102. | MS_2xCD3- scFc | VL CDR2 | AASVLQS |
| 103. | MS_2xCD3- scFc | VL CDR3 | QQSNSFPRT |
| 104. | MS_2xCD3- scFc | VH | QVQLVESGGGLVKPGGSLRLSCAASGFTFSDYYMTWIRQAPGKGLEW ISYISSSGSTIYYADSVKGRFTISRDNAKNSLYLQMNSLRAEDTAVY YCARDRNSHFDYWGQGTLVTVSS |
| 105. | MS_2xCD3- scFc | VL | DIQMTQSPSSVSASVGDRVTITCRASQGITRWLAWYQQKPGKAPKLL IYAASVLQSGVPSRFSGSGSGTDFTLTISSLQPEDFATYYCQQSNSF PRTFGQGTKVEIK |
| 106. | MS_2xCD3- scFc | scFv | QVQLVESGGGLVKPGGSLRLSCAASGFTFSDYYMTWIRQAPGKGLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS |

TABLE 35-continued

| SEQ ID NO: | Designation | Format/ Source | Sequence |
|---|---|---|---|
| Sequence table | | | |
| | | | GVPSRFSGSGSGTDFTLTISSLQPEDFATYYCQQSNSFPRTFGQGTK VEIK |
| 107. | MS_2xCD3-scFc | Bispecific molecule | QVQLVESGGGLVKPGGSLRLSCAASGFTFSDYYMTWIRQAPGKGLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGQGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVL |
| 108. | MS_2xCD3-scFc | Bispecific HLE molecule | QVQLVESGGGLVKPGGSLRLSCAASGFTFSDYYMTWIRQAPGKGLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGQGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGKGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 109. | MS_2xCD3-scFc_delGK | Bispecific HLE molecule | QVQLVESGGGLVKPGGSLRLSCAASGFTFSDYYMTWIRQAPGKGLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGQGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGGGGSGGGGSGGGGSGGGGSGGGGSGGGG SDKTHTCPPCPAPELLGGPSVFLFPPKPKDTLMISRTPEVTCVVVDV SHEDPEVKFNWYVDGVEVHNAKTKPCEEQYGSTYRCVSVLTVLHQDW LNGKEYKCKVSNKALPAPIEKTISKAKGQPREPQVYTLPPSREEMTK NQVSLTCLVKGFYPSDIAVEWESNGQPENNYKTTPPVLDSDGSFFLY SKLTVDKSRWQQGNVFSCSVMHEALHNHYTQKSLSLSPGK |
| 110. | MS_2_CCxCD3-scFc | VH | QVQLVESGGGLVKPGGSLRLSCAASGFTFSDYYMTWIRQAPGKCLEW ISYISSSGSTIYYADSVKGRFTISRDNAKNSLYLQMNSLRAEDTAVY YCARDRNSHFDYWGQGTLVTVSS |
| 111. | MS_2_CCxCD3-scFc | VL | DIQMTQSPSSVSASVGDRVTITCRASQGITRWLAWYQQKPGKAPKLL IYAASVLQSGVPSRFSGSGSGTDFTLTISSLQPEDFATYYCQQSNSF PRTFGCGTKVEIK |
| 112. | MS_2_CCxCD3-scFc | scFv | QVQLVESGGGLVKPGGSLRLSCAASGFTFSDYYMTWIRQAPGKCLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGCGTK VEIK |

TABLE 35-continued

Sequence table

| SEQ ID NO: | Designation | Format/ Source | Sequence |
|---|---|---|---|
| 113. | MS_2_CCxCD 3-scFc | Bispecific molecule | QVQLVESGGGLVKPGGSLRLSCAASGFTFSDYYMTWIRQAPGKCLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGCGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVL |
| 114. | MS_2_CCxCD 3-scFc | Bispecific HLE molecule | QVQLVESGGGLVKPGGSLRLSCAASGFTFSDYYMTWIRQAPGKCLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGCGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGKGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 115. | MS_2_CCxCD 3-scFc_delGK | Bispecific HLE molecule | QVQLVESGGGLVKPGGSLRLSCAASGFTFSDYYMTWIRQAPGKCLEW ISYISSSGSTIYYADSVKGRFTISRDNAKNSLYLQMNSLRAEDTAVY YCARDRNSHFDYWGQGTLVTVSSGGGGSGGGGSGGGGSDIQMTQSPS SVSASVGDRVTITCRASQGITRWLAWYQQKPGKAPKLLIYAASVLQS GVPSRFSGSGSGTDFTLTISSLQPEDFATYYCQQSNSFPRTFGCGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGGGGSGGGGSGGGGSGGGGSGGGGSGGGG SDKTHTCPPCPAPELLGGPSVFLFPPKPKDTLMISRTPEVTCVVVDV SHEDPEVKFNWYVDGVEVHNAKTKPCEEQYGSTYRCVSVLTVLHQDW LNGKEYKCKVSNKALPAPIEKTISKAKGQPREPQVYTLPPSREEMTK NQVSLTCLVKGFYPSDIAVEWESNGQPENNYKTTPPVLDSDGSFFLY SKLTVDKSRWQQGNVFSCSVMHEALHNHYTQKSLSLSPGK |
| 116. | MS_3xCD3- scFc | VH CDR1 | DHYMS |
| 117. | MS_3xCD3- scFc | VH CDR2 | YISSSGGIIYYADSVKG |
| 118. | MS_3xCD3- scFc | VH CDR3 | DVGSHFDY |
| 119. | MS_3xCD3- scFc | VL CDR1 | RASQDISRWLA |
| 120. | MS_3xCD3- scFc | VL CDR2 | AASRLQS |
| 121. | MS_3xCD3- scFc | VL CDR3 | QQAKSFPRT |

TABLE 35-continued

| Sequence table | | | |
|---|---|---|---|
| SEQ ID NO: | Designation | Format/ Source | Sequence |
| 122. | MS_3xCD3-scFc | VH | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSS |
| 123. | MS_3xCD-scFc | VL | DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK |
| 124. | MS_3xCD3-scFc | scFv | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK |
| 125. | MS_3xCD3-scFc | Bispecific molecule | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 126. | MS_3xCD3-scFc | Bispecific HLE molecule | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 127. | MS_3xCD3-scFc_delGK | Bispecific HLE molecule | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 128. | MS_3_CCxCD3-scFc | VH | QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSS |

TABLE 35-continued

| Sequence table | | | |
|---|---|---|---|
| SEQ ID NO: | Designation | Format/ Source | Sequence |
| 129. | MS_3_CCxCD 3-scFc | VL | DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIK |
| 130. | MS_3_CCxCD 3-scFc | scFv | QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIK |
| 131. | MS_3_CCxCD 3-scFc | bispecific molecule | QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 132. | MS_3_CCxCD 3-scFc | Bispecific HLE molecule | QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 133. | MS_3_CCxCD 3-scFc_delGK | Bispecific HLE molecule | QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 134. | CH_1xCD3-scFc | VH CDR1 | SYGMH |
| 135. | CH_1xCD3-scFc | VH CDR2 | FIWYDGSNKYYADSVKD |
| 136. | CH_1xCD3-scFc | VH CDR3 | RAGIIGTIGYYYGMDV |

TABLE 35-continued

Sequence table

| SEQ ID NO: | Designation | Format/ Source | Sequence |
|---|---|---|---|
| 137. | CH_1xCD3-scFc | VL CDR1 | SGDRLGEKYTS |
| 138. | CH_1xCD3-scFc | VL CDR2 | QDTKRPS |
| 139. | CH_1xCD3-scFc | VL CDR3 | QAWESSTVV |
| 140. | CH_1xCD3-scFc | VH | QVQLVESGGGVVQPGGSLRLSCAASGFTFSSYGMHWVRQAPGKGLEW VAFIWYDGSNKYYADSVKDRFTISRDNSKNTLYLQMNSLRAEDTAVY YCARRAGIIGTIGYYYGMDVWGQGTTVTVSS |
| 141. | CH_1xCD3-scFc | VL | SYELTQPPSVSVSPGQTASITCSGDRLGEKYTSWYQQRPGQSPLLVI YQDTKRPSGIPERFSGSNSGNTATLTISGTQAMDEADYYCQAWESST VVFGGGTKLTVL |
| 142. | CH_1xCD3-scFc | scFv | QVQLVESGGGVVQPGGSLRLSCAASGFTFSSYGMHWVRQAPGKGLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVL |
| 143. | CH_1xCD3-scFc | Bispecific molecule | QVQLVESGGGVVQPGGSLRLSCAASGFTFSSYGMHWVRQAPGKGLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 144. | CH_1xCD3-scFc | Bispecific HLE molecule | QVQLVESGGGVVQPGGSLRLSCAASGFTFSSYGMHWVRQAPGKGLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 145. | CH_1xCD3-scFc_deGK | Bispecific HLE molecule | QVQLVESGGGVVQPGGSLRLSCAASGFTFSSYGMHWVRQAPGKGLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG |

TABLE 35-continued

| Sequence table | | | |
|---|---|---|---|
| SEQ ID NO: | Designation | Format/ Source | Sequence |
| | | | NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 146. | CH_1_CCxCD 3-scFc | VH | QVQLVESGGGVVQPGGSLRLSCAASGFTFSSYGMHWVRQAPGKCLEW VAFIWYDGSNKYYADSVKDRFTISRDNSKNTLYLQMNSLRAEDTAVY YCARRAGIIGTIGYYYGMDVWGQGTTVTVSS |
| 147. | CH_1_CCxCD 3-scFc | VL | SYELTQPPSVSVSPGQTASITCSGDRLGEKYTSWYQQRPGQSPLLVI YQDTKRPSGIPERFSGSNSGNTATLTISGTQAMDEADYYCQAWESST VVFGCGTKLTVL |
| 148. | CH_1_CCxCD 3-scFc | scFv | QVQLVESGGGVVQPGGSLRLSCAASGFTFSSYGMHWVRQAPGKCLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVL |
| 149. | CH_1_CCxCD 3-scFc | Bispecific molecule | QVQLVESGGGVVQPGGSLRLSCAASGFTFSSYGMHWVRQAPGKCLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 150. | CH_1_CCxCD 3-scFc | Bispecific HLE molecule | QVQLVESGGGVVQPGGSLRLSCAASGFTFSSYGMHWVRQAPGKCLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 151. | CH_1_CCxCD 3-scFc_delGK | Bispecific HLE molecule | QVQLVESGGGVVQPGGSLRLSCAASGFTFSSYGMHWVRQAPGKCLEW VAFIWYDGSNKYYADSVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL |

TABLE 35-continued

| SEQ ID NO: | Designation | Format/ Source | Sequence |
|---|---|---|---|
| Sequence table | | | |
| | | | TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 152. | CH_2xCD3-scFc | VH CDR1 | SYGMH |
| 153. | CH_2xCD3-scFc | VH CDR2 | FIWYDGSNKYYADSVKG |
| 154. | CH_2xCD3-scFc | VH CDR3 | RAGIIGTIGYYYGMDV |
| 155. | CH_2xCD3-scFc | VL CDR1 | SGDRLGEKYTS |
| 156. | CH_2xCD3-scFc | VL CDR2 | QDTKRPS |
| 157. | CH_2xCD3-scFc | VL CDR3 | QAWESSTVV |
| 158. | CH_2xCD3-scFc | VH | QVQLVESGGGVVQPGGSLRLSCAASGFTFSSYGMHWVRQAPGKGLEW VAFIWYDGSNKYYADSVKGRFTISRDNSKNTLYLQMNSLRAEDTAVY YCARRAGIIGTIGYYYGMDVWGQGTTVTVSS |
| 159. | CH_2xCD3-scFc | VL | SYELTQPPSVSVSPGQTASITCSGDRLGEKYTSWYQQRPGQSPLLVI YQDTKRPSGIPERFSGSNSGNTATLTISGTQAMDEADYYCQAWESST VVFGGGTKLTVL |
| 160. | CH_2xCD3-scFc | scFv | QVQLVESGGGVVQPGGSLRLSCAASGFTFSSYGMHWVRQAPGKGLEW VAFIWYDGSNKYYADSVKGRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVL |
| 161. | CH_2xCD3-scFc | Bispecific molecule | QVQLVESGGGVVQPGGSLRLSCAASGFTFSSYGMHWVRQAPGKGLEW VAFIWYDGSNKYYADSVKGRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 162. | CH_2xCD3-scFc | Bispecific HLE molecule | QVQLVESGGGVVQPGGSLRLSCAASGFTFSSYGMHWVRQAPGKGLEW VAFIWYDGSNKYYADSVKGRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |

TABLE 35-continued

| Sequence table | | | |
|---|---|---|---|
| SEQ ID NO: | Designation | Format/ Source | Sequence |
| 163. | CH_2xCD3-scFc_delGK | Bispecific HLE molecule | QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 164. | CH_2_CCxCD3-scFc | VH | QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSS |
| 165. | CH_2_CCxCD3-scFc | VL | SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL |
| 166. | CH_2_CCxCD3-scFc | scFv | QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL |
| 167. | CH_2_CCxCD3-scFc | bispecific molecule | QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 168. | CH_2_CCxCD3-scFc | bispecific molecule | QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 169. | CH_2_CCxCD 3-scFc_delGK | bispecific molecule | QVQLVESGGGVVQPGGSLRLSCAASGFTFSSYGMHWVRQAPGKCLEW VAFIWYDGSNKYYADSVKGRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 170. | CH_3xCD3- scFc | VH CDR1 | SYGMH |
| 171. | CH_3xCD3- scFc | VH CDR2 | FIWYEGSNKYYAESVKD |
| 172. | CH_3xCD3- scFc | VH CDR3 | RAGIIGTIGYYYGMDV |
| 173. | CH_3xCD3- scFc | VL CDR1 | SGDRLGEKYTS |
| 174. | CH_3xCD3- scFc | VL CDR2 | QDTKRPS |
| 175. | CH_3xCD3- scFc | VL CDR3 | QAWESSTVV |
| 176. | CH_3xCD3- scFc | VH | QVQLVESGGGVVQPGGSLRLSCAASGFTFSSYGMHWVRQAPGKGLEW VAFIWYEGSNKYYAESVKDRFTISRDNSKNTLYLQMNSLRAEDTAVY YCARRAGIIGTIGYYYGMDVWGQGTTVTVSS |
| 177. | CH_3xCD3- scFc | VL | SYELTQPPSVSVSPGQTASITCSGDRLGEKYTSWYQQRPGQSPLLVI YQDTKRPSGIPERFSGSNSGNTATLTISGTQAMDEADYYCQAWESST VVFGGGTKLTVL |
| 178. | CH_3xCD3- scFc | scFv | QVQLVESGGGVVQPGGSLRLSCAASGFTFSSYGMHWVRQAPGKGLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVL |
| 179. | CH_3xCD3- scFc | Bispecific molecule | QVQLVESGGGVVQPGGSLRLSCAASGFTFSSYGMHWVRQAPGKGLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 180. | CH_3xCD3- scFc | Bispecific HLE molecule | QVQLVESGGGVVQPGGSLRLSCAASGFTFSSYGMHWVRQAPGKGLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS |

TABLE 35-continued

| Sequence table | | | |
|---|---|---|---|
| SEQ ID NO: | Designation | Format/ Source | Sequence |
| | | | KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 181. | CH_3xCD3-scFc_delGK | Bispecific HLE molecule | QVQLVESGGGVVQPGGSLRLSCAASGFTFSSYGMHWVRQAPGKGLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 182. | CH_3_CCxCD 3-scFc | VH | QVQLVESGGGVVQPGGSLRLSCAASGFTFSSYGMHWVRQAPGKCLEW VAFIWYEGSNKYYAESVKDRFTISRDNSKNTLYLQMNSLRAEDTAVY YCARRAGIIGTIGYYYGMDVWGQGTTVTVSS |
| 183. | CH_3_CCxCD 3-scFc | VL | SYELTQPPSVSVSPGQTASITCSGDRLGEKYTSWYQQRPGQSPLLVI YQDTKRPSGIPERFSGSNSGNTATLTISGTQAMDEADYYCQAWESST VVFGCGTKLTVL |
| 184. | CH_3_CCxCD 3-scFc | scFv | QVQLVESGGGVVQPGGSLRLSCAASGFTFSSYGMHWVRQAPGKCLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVL |
| 185. | CH_3_CCxCD 3-scFc | Bispecific molecule | QVQLVESGGGVVQPGGSLRLSCAASGFTFSSYGMHWVRQAPGKCLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 186. | CH_3_CCxCD 3-scFc | Bispecific HLE molecule | QVQLVESGGGVVQPGGSLRLSCAASGFTFSSYGMHWVRQAPGKCLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS |

TABLE 35-continued

| SEQ ID NO: | Designation | Format/ Source | Sequence |
|---|---|---|---|
| Sequence table | | | |
| | | | GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 187. | CH_3_CCxCD 3-scFc_delGK | Bispecific HLE molecule | QVQLVESGGGVVQPGGSLRLSCAASGFTFSSYGMHWVRQAPGKCLEW VAFIWYEGSNKYYAESVKDRFTISRDNSKNTLYLQMNSLRAEDTAVY YCARRAGIIGTIGYYYGMDVWGQGTTVTVSSGGGGSGGGGSGGGGSS YELTQPPSVSVSPGQTASITCSGDRLGEKYTSWYQQRPGQSPLLVIY QDTKRPSGIPERFSGSNSGNTATLTISGTQAMDEADYYCQAWESSTV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 188. | DL_1xCD3-scFc | VH CDR1 | SYYWS |
| 189. | DL_1xCD3-scFc | VH CDR2 | YVYYSGTTNYNPSLKS |
| 190. | DL_1xCD3-scFc | VH CDR3 | IAVTGFYFDY |
| 191. | DL_1xCD3-scFc | VL CDR1 | RASQRVNNNYLA |
| 192. | DL_1xCD3-scFc | VL CDR2 | GASSRAT |
| 193. | DL_1xCD3-scFc | VL CDR3 | QQYDRSPLT |
| 194. | DL_1xCD3-scFc | VH | QVQLQESGPGLVKPSETLSLTCTVSGGSISSYYWSWIRQPPGKGLEW IGYVYYSGTTNYNPSLKSRVTISVDTSKNQFSLKLSSVTAADTAVYY CASIAVTGFYFDYWGQGTLVTVSS |
| 195. | DL_1xCD3-scFc | VL | EIVLTQSPGTLSLSPGERVTLSCRASQRVNNNYLAWYQQRPGQAPRL LIYGASSRATGIPDRFSGSGSGTDFTLTISRLEPEDFAVYYCQQYDR SPLTFGGGTKLEIK |
| 196. | DL_1xCD3-scFc | scFv | QVQLQESGPGLVKPSETLSLTCTVSGGSISSYYWSWIRQPPGKGLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGGG TKLEIK |
| 197. | DL_1xCD3-scFc | Bispecific molecule | QVQLQESGPGLVKPSETLSLTCTVSGGSISSYYWSWIRQPPGKGLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGGG TKLEIKSGGGGSEVQLVESGGGLVQPGGSLKLSCAASGFTFNKYAMN WVRQAPGKGLEWVARIRSKYNNYATYYADSVKDRFTISRDDSKNTAY |

TABLE 35-continued

| Sequence table | | | |
|---|---|---|---|
| SEQ ID NO: | Designation | Format/ Source | Sequence |
| | | | LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVL |
| 198. | DL_1xCD3-scFc | Bispecific HLE molecule | QVQLQESGPGLVKPSETLSLTCTVSGGSISSYYWSWIRQPPGKGLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGGG TKLEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGKGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 199. | DL_1xCD3-scFc_delGK | Bispecific HLE molecule | QVQLQESGPGLVKPSETLSLTCTVSGGSISSYYWSWIRQPPGKGLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGGG TKLEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 200. | DL_1_CCxCD3-scFc | VH | QVQLQESGPGLVKPSETLSLTCTVSGGSISSYYWSWIRQPPGKCLEW IGYVYYSGTTNYNPSLKSRVTISVDTSKNQFSLKLSSVTAADTAVYY CASIAVTGFYFDYWGQGTLVTVSS |
| 201. | DL_1_CCxCD3-scFc | VL | EIVLTQSPGTLSLSPGERVTLSCRASQRVNNNYLAWYQQRPGQAPRL LIYGASSRATGIPDRFSGSGSGTDFTLTISRLEPEDFAVYYCQQYDR SPLTFGCGTKLEIK |
| 202. | DL_1_CCxCD3-scFc | scFv | QVQLQESGPGLVKPSETLSLTCTVSGGSISSYYWSWIRQPPGKCLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGCG TKLEIK |
| 203. | DL_1_CCxCD3-scFc | Bispecific molecule | QVQLQESGPGLVKPSETLSLTCTVSGGSISSYYWSWIRQPPGKCLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGCG TKLEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVL |

TABLE 35-continued

Sequence table

| SEQ ID NO: | Designation | Format/ Source | Sequence |
|---|---|---|---|
| 204. | DL_1_CCxCD 3-scFc | Bispecific HLE molecule | QVQLQESGPGLVKPSETLSLTCTVSGGSISSYYWSWIRQPPGKCLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGCG TKLEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGKGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 205. | DL_1_CCxCD 3-scFc_delGK | Bispecific HLE molecule | QVQLQESGPGLVKPSETLSLTCTVSGGSISSYYWSWIRQPPGKCLEW IGYVYYSGTTNYNPSLKSRVTISVDTSKNQFSLKLSSVTAADTAVYY CASIAVTGFYFDYWGQGTLVTVSSGGGGSGGGGSGGGGSEIVLTQSP GTLSLSPGERVTLSCRASQRVNNNYLAWYQQRPGQAPRLLIYGASSR ATGIPDRFSGSGSGTDFTLTISRLEPEDFAVYYCQQYDRSPLTFGCG TKLEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 206. | DL_2xCD3-scFc | VH CDR1 | SFYWS |
| 207. | DL_2xCD3-scFc | VH CDR2 | YIYYSGTTNYNPSLKS |
| 208. | DL_2xCD3-scFc | VH CDR3 | IAVAGFFFDY |
| 209. | DL_2xCD3-scFc | VL CDR1 | RASQSVNKNYLA |
| 210. | DL_2xCD3-scFc | VL CDR2 | GASSRAT |
| 211. | DL_2xCD3-scFc | VL CDR3 | QQYDRSPLT |
| 212. | DL_2xCD3-scFc | VH | QVQLQESGPGLVKPSETLSLTCTVSGASISSFYWSWIRQPPGKGLEW IGYIYYSGTTNYNPSLKSRVTISVDTSKNQFSLKLSSVTAADTAVYY CARIAVAGFFFDYWGQGTLVTVSS |
| 213. | DL_2xCD3-scFc | VL | EIVLTQSPGTLSLSPGERATLSCRASQSVNKNYLAWYQQKPGQAPRL LIYGASSRATGIPDRFSGSGSGTDFTLTISRLEPEDFAVYYCQQYDR SPLTFGGGTKVEIK |
| 214. | DL_2xCD3-scFc | scFv | QVQLQESGPGLVKPSETLSLTCTVSGASISSFYWSWIRQPPGKGLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR |

TABLE 35-continued

| SEQ ID NO: | Designation | Format/ Source | Sequence |
|---|---|---|---|
| | | | ATGIPDRFSGSGSGTDFTLTISRLEPEDFAVYYCQQYDRSPLTFGGG TKVEIK |
| 215. | DL_2xCD3- scFc | Bispecific molecule | QVQLQESGPGLVKPSETLSLTCTVSGASISSFYWSWIRQPPGKGLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGGG TKVEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVL |
| 216. | DL_2xCD3- scFc | Bispecific HLE molecule | QVQLQESGPGLVKPSETLSLTCTVSGASISSFYWSWIRQPPGKGLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGGG TKVEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGKGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 217. | DL_2xCD3- scFc_delGK | Bispecific HLE molecule | QVQLQESGPGLVKPSETLSLTCTVSGASISSFYWSWIRQPPGKGLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGGG TKVEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 218. | DL_2_CCxCD 3-scFc | VH | QVQLQESGPGLVKPSETLSLTCTVSGASISSFYWSWIRQPPGKCLEW IGYIYYSGTTNYNPSLKSRVTISVDTSKNQFSLKLSSVTAADTAVYY CARIAVAGFFFDYWGQGTLVTVSS |
| 219. | DL_2_CCxCD 3-scFc | VL | EIVLTQSPGTLSLSPGERATLSCRASQSVNKNYLAWYQQKPGQAPRL LIYGASSRATGIPDRFSGSGSGTDFTLTISRLEPEDFAVYYCQQYDR SPLTFGCGTKVEIK |
| 220. | DL_2_CCxCD 3-scFc | scFv | QVQLQESGPGLVKPSETLSLTCTVSGASISSFYWSWIRQPPGKCLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGCG TKVEIK |

TABLE 35-continued

Sequence table

| SEQ ID NO: | Designation | Format/ Source | Sequence |
|---|---|---|---|
| 221. | DL_2_CCxCD 3-scFc | Bispecific molecule | QVQLQESGPGLVKPSETLSLTCTVSGASISSFYWSWIRQPPGKCLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGCG TKVEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVL |
| 222. | DL_2_CCxCD 3-scFc | Bispecific HLE molecule | QVQLQESGPGLVKPSETLSLTCTVSGASISSFYWSWIRQPPGKCLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGCG TKVEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGKGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 223. | DL_2_CCxCD 3-scFc_delGK | Bispecific HLE molecule | QVQLQESGPGLVKPSETLSLTCTVSGASISSFYWSWIRQPPGKCLEW IGYIYYSGTTNYNPSLKSRVTISVDTSKNQFSLKLSSVTAADTAVYY CARIAVAGFFFDYWGQGTLVTVSSGGGGSGGGGSGGGGSEIVLTQSP GTLSLSPGERATLSCRASQSVNKNYLAWYQQKPGQAPRLLIYGASSR ATGIPDRFSGSGSGTDFTLTISRLEPEDFAVYYCQQYDRSPLTFGCG TKVEIKSGGGGSEVQLVESGGGLVQPGGSLKLSCAASGFTFNKYAMN WVRQAPGKGLEWVARIRSKYNNYATYYADSVKDRFTISRDDSKNTAY LQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPE DEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIA VEWESNGQPENNYKTTPPVLDSDGSFFLYSKLTVDKSRWQQGNVFSC SVMHEALHNHYTQKSLSLSPGGGGSGGGGSGGGGSGGGGSGGGGSGG GGSDKTHTCPPCPAPELLGGPSVFLFPPKPKDTLMISRTPEVTCVVV DVSHEDPEVKFNWYVDGVEVHNAKTKPCEEQYGSTYRCVSVLTVLHQ DWLNGKEYKCKVSNKALPAPIEKTISKAKGQPREPQVYTLPPSREEM TKNQVSLTCLVKGFYPSDIAVEWESNGQPENNYKTTPPVLDSDGSFF LYSKLTVDKSRWQQGNVFSCSVMHEALHNHYTQKSLSLSPGK |
| 224. | DL_3xCD3-scFc | VH CDR1 | NYYMH |
| 225. | DL_3xCD3-scFc | VH CDR2 | IINPSDGSTSYAQKFQG |
| 226. | DL_3xCD3-scFc | VH CDR3 | GGNSAFYSYYDMDV |
| 227. | DL_3xCD3-scFc | VL CDR1 | RSSQSLVYRDGNTYLS |
| 228. | DL_3xCD3-scFc | VL CDR2 | KVSNWQS |
| 229. | DL_3xCD3-scFc | VL CDR3 | MQGTHWPPT |

TABLE 35-continued

| Sequence table | | | |
|---|---|---|---|
| SEQ ID NO: | Designation | Format/ Source | Sequence |
| 230. | DL_3xCD3-scFc | VH | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSS |
| 231. | DL_3xCD3-scFc | VL | DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 232. | DL_3xCD3-scFc | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 233. | DL_3xCD3-scFc | Bispecific molecule | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 234. | DL_3xCD3-scFc | Bispecific HLE molecule | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 235. | DL_3xCD3-scFc_delGK | Bispecific HLE molecule | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 236. | DL_3_CCxCD 3-scFc | VH | QVQLVQSGAEVKKPGASVKVSCKASGYTFTNYYMHWVRQAPGLCLEW MGIINPSDGSTSYAQKFQGRVTMTRDTSTNTVYMDLSSLRSEDTAVY YCARGGNSAFYSYYDMDVWGQGTTVTVSS |
| 237. | DL_3_CCxCD 3-scFc | VL | DVVMTQTPLSLPVTLGQPASISCRSSQSLVYRDGNTYLSWFQQRPGQ SPRRLIYKVSNWQSGVPDRFSGGGSGTDFTLKISRVEAEDVGVYYCM QGTHWPPTFGCGTKVEIK |
| 238. | DL_3_CCxCD 3-scFc | scFv | QVQLVQSGAEVKKPGASVKVSCKASGYTFTNYYMHWVRQAPGLCLEW MGIINPSDGSTSYAQKFQGRVTMTRDTSTNTVYMDLSSLRSEDTAVY YCARGGNSAFYSYYDMDVWGQGTTVTVSSGGGGSGGGGSGGGGSDVV MTQTPLSLPVTLGQPASISCRSSQSLVYRDGNTYLSWFQQRPGQSPR RLIYKVSNWQSGVPDRFSGGGSGTDFTLKISRVEAEDVGVYYCMQGT HWPPTFGCGTKVEIK |
| 239. | DL_3_CCxCD 3-scFc | Bispecific molecule | QVQLVQSGAEVKKPGASVKVSCKASGYTFTNYYMHWVRQAPGLCLEW MGIINPSDGSTSYAQKFQGRVTMTRDTSTNTVYMDLSSLRSEDTAVY YCARGGNSAFYSYYDMDVWGQGTTVTVSSGGGGSGGGGSGGGGSDVV MTQTPLSLPVTLGQPASISCRSSQSLVYRDGNTYLSWFQQRPGQSPR RLIYKVSNWQSGVPDRFSGGGSGTDFTLKISRVEAEDVGVYYCMQGT HWPPTFGCGTKVEIKSGGGGSEVQLVESGGGLVQPGGSLKLSCAASG FTFNKYAMNWVRQAPGKGLEWVARIRSKYNNYATYYADSVKDRFTIS RDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAA LTLSGVQPEDEAEYYCVLWYSNRWVFGGGTKLTVL |
| 240. | DL_3_CCxCD 3-scFc | Bispecific HLE molecule | QVQLVQSGAEVKKPGASVKVSCKASGYTFTNYYMHWVRQAPGLCLEW MGIINPSDGSTSYAQKFQGRVTMTRDTSTNTVYMDLSSLRSEDTAVY YCARGGNSAFYSYYDMDVWGQGTTVTVSSGGGGSGGGGSGGGGSDVV MTQTPLSLPVTLGQPASISCRSSQSLVYRDGNTYLSWFQQRPGQSPR RLIYKVSNWQSGVPDRFSGGGSGTDFTLKISRVEAEDVGVYYCMQGT HWPPTFGCGTKVEIKSGGGGSEVQLVESGGGLVQPGGSLKLSCAASG FTFNKYAMNWVRQAPGKGLEWVARIRSKYNNYATYYADSVKDRFTIS RDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAA LTLSGVQPEDEAEYYCVLWYSNRWVFGGGTKLTVLGGGGDKTHTCPP CPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCK VSNKALPAPIEKTISKAKGQPREPQVYTLPPSREEMTKNQVSLTCLV KGFYPSDIAVEWESNGQPENNYKTTPPVLDSDGSFFLYSKLTVDKSR WQQGNVFSCSVMHEALHNHYTQKSLSLSPGKGGGGSGGGGSGGGGSG GGGSGGGGSGGGGSDKTHTCPPCPAPELLGGPSVFLFPPKPKDTLMI SRTPEVTCVVVDVSHEDPEVKFNWYVDGVEVHNAKTKPCEEQYGSTY RCVSVLTVLHQDWLNGKEYKCKVSNKALPAPIEKTISKAKGQPREPQ VYTLPPSREEMTKNQVSLTCLVKGFYPSDIAVEWESNGQPENNYKTT PPVLDSDGSFFLYSKLTVDKSRWQQGNVFSCSVMHEALHNHYTQKSL SLSPGK |
| 241. | DL_3_CCxCD 3-scFc_delGK | Bispecific HLE molecule | QVQLVQSGAEVKKPGASVKVSCKASGYTFTNYYMHWVRQAPGLCLEW MGIINPSDGSTSYAQKFQGRVTMTRDTSTNTVYMDLSSLRSEDTAVY YCARGGNSAFYSYYDMDVWGQGTTVTVSSGGGGSGGGGSGGGGSDVV MTQTPLSLPVTLGQPASISCRSSQSLVYRDGNTYLSWFQQRPGQSPR RLIYKVSNWQSGVPDRFSGGGSGTDFTLKISRVEAEDVGVYYCMQGT HWPPTFGCGTKVEIKSGGGGSEVQLVESGGGLVQPGGSLKLSCAASG FTFNKYAMNWVRQAPGKGLEWVARIRSKYNNYATYYADSVKDRFTIS RDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAA LTLSGVQPEDEAEYYCVLWYSNRWVFGGGTKLTVLGGGGDKTHTCPP CPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCK VSNKALPAPIEKTISKAKGQPREPQVYTLPPSREEMTKNQVSLTCLV KGFYPSDIAVEWESNGQPENNYKTTPPVLDSDGSFFLYSKLTVDKSR WQQGNVFSCSVMHEALHNHYTQKSLSLSPGGGGSGGGGSGGGGSGGG GSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRC VSVLTVLHQDWLNGKEYKCKVSNKALPAPIEKTISKAKGQPREPQVY TLPPSREEMTKNQVSLTCLVKGFYPSDIAVEWESNGQPENNYKTTPP VLDSDGSFFLYSKLTVDKSRWQQGNVFSCSVMHEALHNHYTQKSLSL SPGK |

TABLE 35-continued

| SEQ ID NO: | Designation | Format/ Source | Sequence |
|---|---|---|---|
| 242. | C19_1xCD3-scFc | VH CDR1 | SYGVS |
| 243. | C19_1xCD3-scFc | VH CDR2 | YNDPVFGSIYYASWVKG |
| 244. | C19_1xCD3-scFc | VH CDR3 | DRSYVSSSGYHFNL |
| 245. | C19_1xCD3-scFc | VL CDR1 | QASETIYSSLA |
| 246. | C19_1xCD3-scFc | VL CDR2 | GASNLES |
| 247. | C19_1xCD3-scFc | VL CDR3 | QSGVYSAGLT |
| 248. | C19_1xCD3-scFc | VH | EVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS |
| 249. | C19_1xCD3-scFc | VL | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIK |
| 250. | C19_1xCD3-scFc | scFv | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS |
| 251. | C19_1xCD3-scFc | Bispecific molecule | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 252. | C19_1xCD3-scFc | Bispecific HLE molecule | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 253. | C19_1_CCxCD3-scFc | VH | EVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS |

TABLE 35-continued

| Sequence table | | | |
|---|---|---|---|
| SEQ ID NO: | Designation | Format/ Source | Sequence |
| 254. | C19_1_CCxCD3-scFc | VL | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIK |
| 255. | C19_1_CCxCD3-scFc | scFv | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS |
| 256. | C19_1_CCxCD3-scFc | bispecific molecule | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 257. | C19_1_CCxCD3-scFc | bispecific molecule | DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 258. | C19_2xCD3-scFc | VH CDR1 | SYGVS |
| 259. | C19_2xCD3-scFc | VH CDR2 | YNDPVFGSIYYASWVKG |
| 260. | C19_2xCD3-scFc | VH CDR3 | DRSYVSSSGYHFNL |
| 261. | C19_2xCD3-scFc | VL CDR1 | QASETIYSSLA |
| 262. | C19_2xCD3-scFc | VL CDR2 | GASNLES |
| 263. | C19_2xCD3-scFc | VL CDR3 | QSGVYSAGLT |
| 264. | C19_2xCD3-scFc | VH | EVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS |
| 265. | C19_2xCD3-scFc | VL | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIK |

TABLE 35-continued

Sequence table

| SEQ ID NO: | Designation | Format/ Source | Sequence |
|---|---|---|---|
| 266. | C19_2xCD3-scFc | scFv | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS |
| 267. | C19_2xCD3-scFc | Bispecific molecule | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 268. | C19_2xCD3-scFc | Bispecific HLE molecule | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 269. | C19_2_CCxCD3-scFc | VH | EVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS |
| 270. | C19_2_CCxCD3-scFc | VL | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIK |
| 271. | C19_2_CCxCD3-scFc | scFv | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS |
| 272. | C19_2_CCxCD3-scFc | bispecific molecule | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 273. | C19_2_CCxCD3-scFc | bispecific molecule | DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNL |

TABLE 35-continued

Sequence table

| SEQ ID NO: | Designation | Format/ Source | Sequence |
|---|---|---|---|
| | | | WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG K |
| 274. | C19_3xCD3-scFc | VH CDR1 | SYGVS |
| 275. | C19_3xCD3-scFc | VH CDR2 | YNDPVFGSIYYASWVKG |
| 276. | C19_3xCD3-scFc | VH CDR3 | DRSYVSSSGYHFNL |
| 277. | C19_3xCD3-scFc | VL CDR1 | QASETIYSSLA |
| 278. | C19_3xCD3-scFc | VL CDR2 | GASNLES |
| 279. | C19_3xCD3-scFc | VL CDR3 | QSGVYSAGLT |
| 280. | C19_3xCD3-scFc | VH | EVQLLESGGGLVQPGGSLRLSCAASGFTFSSYGVSWVRQAPGKGLEW IGYNDPVFGSIYYASWVKGRFTISSDNSKNTLYLQMNSLRAEDTAVY YCAKDRSYVSSSGYHFNLWGQGTLVTVSS |
| 281. | C19_3xCD3-scFc | VL | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGGGTKVEIK |
| 282. | C19_3xCD3-scFc | scFv | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWIGYNDPVFGSIYYASWVK GRFTISSDNSKNTLYLQMNSLRAEDTAVYYCAKDRSYVSSSGYHFNL WGQGTLVTVSS |
| 283. | C19_3xCD3-scFc | bispecific molecule | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWIGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVL |
| 284. | C19_3xCD3-scFc | bispecific molecule | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWIGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD |

TABLE 35-continued

| Sequence table | | | |
|---|---|---|---|
| SEQ ID NO: | Designation | Format/ Source | Sequence |
| | | | GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG K |
| 285. | C19_3_CCxCD3-scFc | VH | EVQLLESGGGLVQPGGSLRLSCAASGFTFSSYGVSWVRQAPGKCLEW IGYNDPVFGSIYYASWVKGRFTISSDNSKNTLYLQMNSLRAEDTAVY YCAKDRSYVSSSGYHFNLWGQGTLVTVSS |
| 286. | C19_3_CCxCD3-scFc | VL | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGCGTKVEIK |
| 287. | C19_3_CCxCD3-scFc | scFv | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWIGYNDPVFGSIYYASWVK GRFTISSDNSKNTLYLQMNSLRAEDTAVYYCAKDRSYVSSSGYHFNL WGQGTLVTVSS |
| 288. | C19_3_CCxCD3-scFc | Bispecific molecule | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWIGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVL |
| 289. | C19_3_CCxCD3-scFc | Bispecific HLE molecule | DIQMTQSPSSLSASVGDRVTITCQASETIYSSLAWYQQKPGKAPKLL IYGASNLESGVPSRFSGSGSGTDFTFTISGLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWIGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG K |
| 290. | C19_4xCD3-scFc | VH CDR1 | SYGVS |
| 291. | C19_4xCD3-scFc | VH CDR2 | YNDPVFGSIYYASWVKG |
| 292. | C19_4xCD3-scFc | VH CDR3 | DRSYVSSSGYHFNL |
| 293. | C19_4xCD3-scFc | VL CDR1 | QASETIYSSLA |
| 294. | C19_4xCD3-scFc | VL CDR2 | GASNLES |

TABLE 35-continued

| SEQ ID NO: | Designation | Format/ Source | Sequence |
|---|---|---|---|
| Sequence table | | | |
| 295. | C19_4xCD3-scFc | VL CDR3 | QSGVYSAGLT |
| 296. | C19_4xCD3-scFc | VH | EVQLLESGGGLVQPGGSLRLSCAASGFTFSSYGVSWVRQAPGKGLEW VGYNDPVFGSIYYASWVKGRFTISSDNSKNTLYLQMNSLRAEDTAVY YCAKDRSYVSSSGYHFNLWGQGTLVTVSS |
| 297. | C19_4xCD3-scFc | VL | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGGGTKVEIK |
| 298. | C19_4xCD3-scFc | scFv | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWVGYNDPVFGSIYYASWVK GRFTISSDNSKNTLYLQMNSLRAEDTAVYYCAKDRSYVSSSGYHFNL WGQGTLVTVSS |
| 299. | C19_4xCD3-scFc | Bispecific molecule | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWVGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVL |
| 300. | C19_4xCD3-scFc | Bispecific HLE molecule | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWVGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG K |
| 301. | C19_4_CCxCD3-scFc | VH | EVQLLESGGGLVQPGGSLRLSCAASGFTFSSYGVSWVRQAPGKCLEW VGYNDPVFGSIYYASWVKGRFTISSDNSKNTLYLQMNSLRAEDTAVY YCAKDRSYVSSSGYHFNLWGQGTLVTVSS |
| 302. | C19_4_CCxCD3-scFc | VL | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGCGTKVEIK |
| 303. | C19_4_CCxCD3-scFc | scFv | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWVGYNDPVFGSIYYASWVK GRFTISSDNSKNTLYLQMNSLRAEDTAVYYCAKDRSYVSSSGYHFNL WGQGTLVTVSS |
| 304. | C19_4_CCxCD3-scFc | Bispecific molecule | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWVGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK |

TABLE 35-continued

Sequence table

| SEQ ID NO: | Designation | Format/ Source | Sequence |
|---|---|---|---|
| | | | YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVL |
| 305. | C19_4_CCxC D3-scFc | Bispecific HLE molecule | DIQMTQSPSSLSASVGDRVTITCQASETIYSSLAWYQQKPGKAPKLL IYGASNLESGVPSRFSGSGSGTDFTFTISSLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWVGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG K |
| 306. | C19_1xCD3-scFc_delGK | Bispecific HLE molecule | DIQMTQSPSSLSASVGDRVTITCQASETIYSSLAWYQQKPGKPPKLL IYGASNLESGVPSRFSGSGSGTDFTFTISSLQPEDIATYYCQSGVYS AGLTFGGGTKVEIKGGGGSGGGGSGGGGSEVQLLESGGGLVQPGGSL RLSCAASGFTFSSYGVSWVRQAPGKGLEWIGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 307. | C19_1_CCxC D3-scFc_delGK | Bispecific HLE molecule | DIQMTQSPSSLSASVGDRVTITCQASETIYSSLAWYQQKPGKPPKLL IYGASNLESGVPSRFSGSGSGTDFTFTISSLQPEDIATYYCQSGVYS AGLTFGCGTKVEIKGGGGSGGGGSGGGGSEVQLLESGGGLVQPGGSL RLSCAASGFTFSSYGVSWVRQAPGKCLEWIGYNDPVFGSIYYASWVK GRFTISSDNSKNTLYLQMNSLRAEDTAVYYCAKDRSYVSSSGYHFNL WGQGTLVTVSSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 35-continued

Sequence table

| SEQ ID NO: | Designation | Format/ Source | Sequence |
|---|---|---|---|
| 308. | C19_2xCD3-scFc_delGK | Bispecific HLE molecule | DIQMTQSPSSLSASVGDRVTITCQASETIYSSLAWYQQKPGKAPKLL<br>IYGASNLESGVPSRFSGSGSGTDFTFTISSMQPEDIATYYCQSGVYS<br>AGLTFGGGTKVEIKGGGGSGGGGSGGGGSEVQLLESGGGLVQPGGSL<br>RLSCAASGFTFSSYGVSWVRQAPGKGLEWIGYNDPVFGSIYYASWVK<br>GRFTISSDNSKNTLYLQMNSLRAEDTAVYYCAKDRSYVSSSGYHFNL<br>WGQGTLVTVSSGGGGSEVQLVESGGGLVQPGGSLKLSCAASGFTFNK<br>YAMNWVRQAPGKGLEWVARIRSKYNNYATYYADSVKDRFTISRDDSK<br>NTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSG<br>NYPNWVQQKPGQAPRGLIGGTKFLAPGTPARFSGSLLGGKAALTLSG<br>VQPEDEAEYYCVLWYSNRWVFGGGTKLTVLGGGGDKTHTCPPCPAPE<br>LLGGPSVFLFPPKPKDTLMISRTPEVTCVVVDVSHEDPEVKFNWYVD<br>GVEVHNAKTKPCEEQYGSTYRCVSVLTVLHQDWLNGKEYKCKVSNKA<br>LPAPIEKTISKAKGQPREPQVYTLPPSREEMTKNQVSLTCLVKGFYP<br>SDIAVEWESNGQPENNYKTTPPVLDSDGSFFLYSKLTVDKSRWQQGN<br>VFSCSVMHEALHNHYTQKSLSLSPGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 309. | C19_2_CCxCD3-scFc_delGK | Bispecific HLE molecule | DIQMTQSPSSLSASVGDRVTITCQASETIYSSLAWYQQKPGKAPKLL<br>IYGASNLESGVPSRFSGSGSGTDFTFTISSMQPEDIATYYCQSGVYS<br>AGLTFGCGTKVEIKGGGGSGGGGSGGGGSEVQLLESGGGLVQPGGSL<br>RLSCAASGFTFSSYGVSWVRQAPGKCLEWIGYNDPVFGSIYYASWVK<br>GRFTISSDNSKNTLYLQMNSLRAEDTAVYYCAKDRSYVSSSGYHFNL<br>WGQGTLVTVSSGGGGSEVQLVESGGGLVQPGGSLKLSCAASGFTFNK<br>YAMNWVRQAPGKGLEWVARIRSKYNNYATYYADSVKDRFTISRDDSK<br>NTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSG<br>NYPNWVQQKPGQAPRGLIGGTKFLAPGTPARFSGSLLGGKAALTLSG<br>VQPEDEAEYYCVLWYSNRWVFGGGTKLTVLGGGGDKTHTCPPCPAPE<br>LLGGPSVFLFPPKPKDTLMISRTPEVTCVVVDVSHEDPEVKFNWYVD<br>GVEVHNAKTKPCEEQYGSTYRCVSVLTVLHQDWLNGKEYKCKVSNKA<br>LPAPIEKTISKAKGQPREPQVYTLPPSREEMTKNQVSLTCLVKGFYP<br>SDIAVEWESNGQPENNYKTTPPVLDSDGSFFLYSKLTVDKSRWQQGN<br>VFSCSVMHEALHNHYTQKSLSLSPGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 310. | C19_3xCD3-scFc_delGK | Bispecific HLE molecule | DIQMTQSPSSLSASVGDRVTITCQASETIYSSLAWYQQKPGKAPKLL<br>IYGASNLESGVPSRFSGSGSGTDFTFTISGLQPEDIATYYCQSGVYS<br>AGLTFGGGTKVEIKGGGGSGGGGSGGGGSEVQLLESGGGLVQPGGSL<br>RLSCAASGFTFSSYGVSWVRQAPGKGLEWIGYNDPVFGSIYYASWVK<br>GRFTISSDNSKNTLYLQMNSLRAEDTAVYYCAKDRSYVSSSGYHFNL<br>WGQGTLVTVSSGGGGSEVQLVESGGGLVQPGGSLKLSCAASGFTFNK<br>YAMNWVRQAPGKGLEWVARIRSKYNNYATYYADSVKDRFTISRDDSK<br>NTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSG<br>NYPNWVQQKPGQAPRGLIGGTKFLAPGTPARFSGSLLGGKAALTLSG<br>VQPEDEAEYYCVLWYSNRWVFGGGTKLTVLGGGGDKTHTCPPCPAPE<br>LLGGPSVFLFPPKPKDTLMISRTPEVTCVVVDVSHEDPEVKFNWYVD<br>GVEVHNAKTKPCEEQYGSTYRCVSVLTVLHQDWLNGKEYKCKVSNKA<br>LPAPIEKTISKAKGQPREPQVYTLPPSREEMTKNQVSLTCLVKGFYP<br>SDIAVEWESNGQPENNYKTTPPVLDSDGSFFLYSKLTVDKSRWQQGN<br>VFSCSVMHEALHNHYTQKSLSLSPGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 311. | C19_3_CCxCD3-scFc_delGK | Bispecific HLE molecule | DIQMTQSPSSLSASVGDRVTITCQASETIYSSLAWYQQKPGKAPKLL<br>IYGASNLESGVPSRFSGSGSGTDFTFTISGLQPEDIATYYCQSGVYS<br>AGLTFGCGTKVEIKGGGGSGGGGSGGGGSEVQLLESGGGLVQPGGSL<br>RLSCAASGFTFSSYGVSWVRQAPGKCLEWIGYNDPVFGSIYYASWVK<br>GRFTISSDNSKNTLYLQMNSLRAEDTAVYYCAKDRSYVSSSGYHFNL<br>WGQGTLVTVSSGGGGSEVQLVESGGGLVQPGGSLKLSCAASGFTFNK<br>YAMNWVRQAPGKGLEWVARIRSKYNNYATYYADSVKDRFTISRDDSK<br>NTAYLQMNNLKTEDTAVYYCVRHGNFGNSYISYWAYWGQGTLVTVSS |

TABLE 35-continued

| Sequence table | | | |
|---|---|---|---|
| SEQ ID NO: | Designation | Format/ Source | Sequence |
| | | | GGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 312. | C19_4xCD3-scFc_delGK | Bispecific HLE molecule | DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 313. | C19_4_CCxCD3-scFc_delGK | Bispecific HLE molecule | DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 314. | FL_1xCD3-scFc | VH CDR1 | NARMGVS |
| 315. | FL_1xCD3-scFc | VH CDR2 | NIFSNDEKSYSTSLKS |
| 316. | FL_1xCD3-scFc | VH CDR3 | IVGYGSGWYGYFDY |
| 317. | FL_1xCD3-scFc | VL CDR1 | RASQGIRNDLG |
| 318. | FL_1xCD3-scFc | VL CDR2 | AASSLQS |
| 319. | FL_1xCD3-scFc | VL CDR3 | LQHNSYPLT |

TABLE 35-continued

Sequence table

| SEQ ID NO: | Designation | Format/ Source | Sequence |
|---|---|---|---|
| 320. | FL_1xCD3-scFc | VH | QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSS |
| 321. | FL_1xCD3-scFc | VL | DIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKS |
| 322. | FL_1xCD3-scFc | scFv | QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIK |
| 323. | FL_1xCD3-scFc | Bispecific molecule | QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 324. | FL_1xCD3-scFc | Bispecific HLE molecule | QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 325. | FL_1_CCxCD3-scFc | VH | QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSS |
| 326. | FL_1_CCxCD3-scFc | VL | DIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIK |
| 327. | FL_1_CCxCD3-scFc | scFv | QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKS |
| 328. | FL_1_CCxCD3-scFc | Bispecific molecule | QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTS |

TABLE 35-continued

| SEQ ID NO: | Designation | Format/ Source | Sequence |
|---|---|---|---|
| | | | GNYPNWVQQKPGQAPRGLIGGTKFLAPGTPARFSGSLLGGKAALTLS GVQPEDEAEYYCVLWYSNRWVFGGGTKLTVL |
| 329. | FL_1_CCxCD 3-scFc | Bispecific HLE molecule | QVTLKESGPALVKPTETLTLTCTVSGFSLSNARMGVSWIRQPPGKCL EWLANIFSNDEKSYSTSLKSRLTISKGTSKSQVVLTMTNMDPEDTAT YYCARIVGYGSGWYGYFDYWGQGTLVTVSSGGGGSGGGGSGGGGSDI QMTQSPSSLSASVGDRVTITCRASQGIRNDLGWYQQKPGKAPQRLIY AASSLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 330. | FL_2xCD3-scFc | VH CDR1 | NARMGVS |
| 331. | FL_2xCD3-scFc | VH CDR2 | HIFSNDEKSYSTSLKN |
| 332. | FL_2xCD3-scFc | VH CDR3 | IVGYGSGWYGFFDY |
| 333. | FL_2xCD3-scFc | VL CDR1 | RASQGIRNDLG |
| 334. | FL_2xCD3-scFc | VL CDR2 | AASTLQS |
| 335. | FL_2xCD3-scFc | VL CDR3 | LQHNSYPLT |
| 336. | FL_2xCD3-scFc | VH | QVTLKESGPTLVKPTETLTLTCTLSGFSLNNARMGVSWIRQPPGKAL EWLAHIFSNDEKSYSTSLKNRLTISKDSSKTQVVLTMTNVDPVDTAT YYCARIVGYGSGWYGFFDYWGQGTLVTVSS |
| 337. | FL_2xCD3-scFc | VL | DIQMTQSPSSLSASVGDRVTITCRASQGIRNDLGWYQQKPGKAPKRL IYAASTLQSGVPSRFSGSGSGTEFTLTISSLQPEDFATYYCLQHNSY PLTFGGGTKVEIK |
| 338. | FL_2xCD3-scFc | scFv | QVTLKESGPTLVKPTETLTLTCTLSGFSLNNARMGVSWIRQPPGKAL EWLAHIFSNDEKSYSTSLKNRLTISKDSSKTQVVLTMTNVDPVDTAT YYCARIVGYGSGWYGFFDYWGQGTLVTVSSGGGGSGGGGSGGGGSDI QMTQSPSSLSASVGDRVTITCRASQGIRNDLGWYQQKPGKAPKRLIY AASTLQSGVPSRFSGSGSGTEFTLTISSLQPEDFATYYCLQHNSYPL TFGGGTKVEIKS |
| 339. | FL_2xCD3-scFc | Bispecific molecule | QVTLKESGPTLVKPTETLTLTCTLSGFSLNNARMGVSWIRQPPGKAL EWLAHIFSNDEKSYSTSLKNRLTISKDSSKTQVVLTMTNVDPVDTAT YYCARIVGYGSGWYGFFDYWGQGTLVTVSSGGGGSGGGGSGGGGSDI QMTQSPSSLSASVGDRVTITCRASQGIRNDLGWYQQKPGKAPKRLIY AASTLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 340. | FL_2xCD3-scFc | Bispecific HLE molecule | QVTLKESGPTLVKPTETLTLTCTLSGFSLNNARMGVSWIRQPPGKAL EWLAHIFSNDEKSYSTSLKNRLTISKDSSKTQVVLTMTNVDPVDTAT YYCARIVGYGSGWYGFFDYWGQGTLVTVSSGGGGSGGGGSGGGGSDI QMTQSPSSLSASVGDRVTITCRASQGIRNDLGWYQQKPGKAPKRLIY |

TABLE 35-continued

| Sequence table | | | |
|---|---|---|---|
| SEQ ID NO: | Designation | Format/ Source | Sequence |
| | | | AASTLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 341. | FL_2_CCxCD 3-scFc | VH | QVTLKESGPTLVKPTETLTLTCTLSGFSLNNARMGVSWIRQPPGKCL EWLAHIFSNDEKSYSTSLKNRLTISKDSSKTQVVLTMTNVDPVDTAT YYCARIVGYGSGWYGFFDYWGQGTLVTVSS |
| 342. | FL_2_CCxCD 3-scFc | VL | DIQMTQSPSSLSASVGDRVTITCRASQGIRNDLGWYQQKPGKAPKRL IYAASTLQSGVPSRFSGSGSGTEFTLTISSLQPEDFATYYCLQHNSY PLTFGCGTKVEIK |
| 343. | FL_2_CCxCD 3-scFc | scFv | QVTLKESGPTLVKPTETLTLTCTLSGFSLNNARMGVSWIRQPPGKCL EWLAHIFSNDEKSYSTSLKNRLTISKDSSKTQVVLTMTNVDPVDTAT YYCARIVGYGSGWYGFFDYWGQGTLVTVSSGGGGSGGGGSGGGGSDI QMTQSPSSLSASVGDRVTITCRASQGIRNDLGWYQQKPGKAPKRLIY AASTLQSGVPSRFSGSGSGTEFTLTISSLQPEDFATYYCLQHNSYPL TFGCGTKVEIKS |
| 344. | FL_2_CCxCD 3-scFc | Bispecific molecule | QVTLKESGPTLVKPTETLTLTCTLSGFSLNNARMGVSWIRQPPGKCL EWLAHIFSNDEKSYSTSLKNRLTISKDSSKTQVVLTMTNVDPVDTAT YYCARIVGYGSGWYGFFDYWGQGTLVTVSSGGGGSGGGGSGGGGSDI QMTQSPSSLSASVGDRVTITCRASQGIRNDLGWYQQKPGKAPKRLIY AASTLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 345. | FL_2_CCxCD 3-scFc | Bispecific HLE molecule | QVTLKESGPTLVKPTETLTLTCTLSGFSLNNARMGVSWIRQPPGKCL EWLAHIFSNDEKSYSTSLKNRLTISKDSSKTQVVLTMTNVDPVDTAT YYCARIVGYGSGWYGFFDYWGQGTLVTVSSGGGGSGGGGSGGGGSDI QMTQSPSSLSASVGDRVTITCRASQGIRNDLGWYQQKPGKAPKRLIY AASTLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 346. | FL_3xCD3-scFc | VH CDR1 | NARMAVS |
| 347. | FL_3xCD3-scFc | VH CDR2 | HIFSNDEKSYSTSLKS |

TABLE 35-continued

| SEQ ID NO: | Designation | Format/ Source | Sequence |
|---|---|---|---|
| Sequence table | | | |
| 348. | FL_3xCD3-scFc | VH CDR3 | IVGYGSGWYGYFDY |
| 349. | FL_3xCD3-scFc | VL CDR1 | RASQDIRNDLG |
| 350. | FL_3xCD3-scFc | VL CDR2 | AASTLQS |
| 351. | FL_3xCD3-scFc | VL CDR3 | LQHNSYPLT |
| 352. | FL_3xCD3-scFc | VH | QVTLKESGPALVKPTETLTLTCTLSGFSLNNARMAVSWIRQPPGKTL EWLAHIFSNDEKSYSTSLKSRLTISKDTSKGQVVLTMTNMDPVDTAT YYCARIVGYGSGWYGYFDYWGQGTLVTVSS |
| 353. | FL_3xCD3-scFc | VL | DIQMTQSPSSLSASVGDRVTITCRASQDIRNDLGWYQQKPGKAPKRL IYAASTLQSGVPSRFSGSGSGTEFTLTISSLQPEDFATYYCLQHNSY PLTFGGGTKVEIK |
| 354. | FL_3xCD3-scFc | scFv | QVTLKESGPALVKPTETLTLTCTLSGFSLNNARMAVSWIRQPPGKTL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGGGTKVEIKS |
| 355. | FL_3xCD3-scFc | Bispecific molecule | QVTLKESGPALVKPTETLTLTCTLSGFSLNNARMAVSWIRQPPGKTL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 356. | FL_3xCD3-scFc | Bispecific HLE molecule | QVTLKESGPALVKPTETLTLTCTLSGFSLNNARMAVSWIRQPPGKTL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 357. | FL_3_CCxCD 3-scFc | VH | QVTLKESGPALVKPTETLTLTCTLSGFSLNNARMAVSWIRQPPGKCL EWLAHIFSNDEKSYSTSLKSRLTISKDTSKGQVVLTMTNMDPVDTAT YYCARIVGYGSGWYGYFDYWGQGTLVTVSS |
| 358. | FL_3_CCxCD 3-scFc | VL | DIQMTQSPSSLSASVGDRVTITCRASQDIRNDLGWYQQKPGKAPKRL IYAASTLQSGVPSRFSGSGSGTEFTLTISSLQPEDFATYYCLQHNSY PLTFGCGTKVEIK |

TABLE 35-continued

| SEQ ID NO: | Designation | Format/ Source | Sequence |
|---|---|---|---|
| Sequence table | | | |
| 359. | FL_3_CCxCD 3-scFc | scFv | QVTLKESGPALVKPTETLTLTCTLSGFSLNNARMAVSWIRQPPGKCL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGCGTKVEIKS |
| 360. | FL_3_CCxCD 3-scFc | Bispecific molecule | QVTLKESGPALVKPTETLTLTCTLSGFSLNNARMAVSWIRQPPGKCL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLG |
| 361. | FL_3_CCxCD 3-scFc | Bispecific HLE molecule | QVTLKESGPALVKPTETLTLTCTLSGFSLNNARMAVSWIRQPPGKCL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 362. | FL_4xCD3-scFc | VH CDR1 | NAKMGVS |
| 363. | FL_4xCD3-scFc | VH CDR2 | HIFSNDEKSYSTSLKS |
| 364. | FL_4xCD3-scFc | VH CDR3 | IVGYGSGWYGYFDY |
| 365. | FL_4xCD3-scFc | VL CDR1 | RASQDIRDDLG |
| 366. | FL_4xCD3-scFc | VL CDR2 | GASTLQS |
| 367. | FL_4xCD3-scFc | VL CDR3 | LQHNSYPLT |
| 368. | FL_4xCD3-scFc | VH | QVTLKESGPALVKPTETLTLTCTLSGFSLNNAKMGVSWIRQPPGKAL EWLAHIFSNDEKSYSTSLKSRLTISKDTSKGQVVLTMTNMDPVDTAT YYCARIVGYGSGWYGYFDYWGQGTLVTVSS |
| 369. | FL_4xCD3-scFc | VL | DIQMTQSPSSLSASVGDRVTITCRASQDIRDDLGWYQQKPGNAPKRL IYGASTLQSGVPSRFSGSGSGTEFTLTISSLQPEDFATYYCLQHNSY PLTFGGGTKVDIK |
| 370. | FL_4xCD3-scFc | scFv | QVTLKESGPALVKPTETLTLTCTLSGFSLNNAKMGVSWIRQPPGKAL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGGGTKVDIKS |

TABLE 35-continued

| Sequence table | | | |
|---|---|---|---|
| SEQ ID NO: | Designation | Format/ Source | Sequence |
| 371. | FL_4xCD3-scFc | Bispecific molecule | QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 372. | FL_4xCD3-scFc | Bispecific HLE molecule | QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 373. | FL_4_CCxCD3-scFc | VH | QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSS |
| 374. | FL_4_CCxCD3-scFc | VL | DIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIK |
| 375. | FL_4_CCxCD3-scFc | scFv | QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKS |
| 376. | FL_4_CCxCD3-scFc | Bispecific molecule | QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 377. | FL_4_CCxCD3-scFc | Bispecific HLE molecule | QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYV |

TABLE 35-continued

| Sequence table | | | |
|---|---|---|---|
| SEQ ID NO: | Designation | Format/ Source | Sequence |
| | | | DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 378. | FL_5xCD3-scFc | VH CDR1 | NARMAVS |
| 379. | FL_5xCD3-scFc | VH CDR2 | HIFSNDEKSYSTSLKS |
| 380. | FL_5xCD3-scFc | VH CDR3 | IVGYGSGWYGYFDY |
| 381. | FL_5xCD3-scFc | VL CDR1 | RASQDIRYDLA |
| 382. | FL_5xCD3-scFc | VL CDR2 | AASSLQS |
| 383. | FL_5xCD3-scFc | VL CDR3 | LQHNFYPLT |
| 384. | FL_5xCD3-scFc | VH | QVTLKESGPVLVKPTETLTLTCTVSGFSLRNARMAVSWIRQPPGKTL EWLAHIFSNDEKSYSTSLKSRLTISKDTSKSQVVLTMTNMDPVDTAT YYCARIVGYGSGWYGYFDYWGQGTLVTVSS |
| 385. | FL_5xCD3-scFc | VL | DIQMTQSPSSVSASVGDRVTITCRASQDIRYDLAWYQQKPGKAPKRL IYAASSLQSGVPSRFSGSGSGTEFTLTISSLQPEDFATYYCLQHNFY PLTFGGGTKVEIK |
| 386. | FL_5xCD3-scFc | scFv | QVTLKESGPVLVKPTETLTLTCTVSGFSLRNARMAVSWIRQPPGKTL EWLAHIFSNDEKSYSTSLKSRLTISKDTSKSQVVLTMTNMDPVDTAT YYCARIVGYGSGWYGYFDYWGQGTLVTVSSGGGGSGGGGSGGGGSDI QMTQSPSSVSASVGDRVTITCRASQDIRYDLAWYQQKPGKAPKRLIY AASSLQSGVPSRFSGSGSGTEFTLTISSLQPEDFATYYCLQHNFYPL TFGGGTKVEIKS |
| 387. | FL_5xCD3-scFc | Bispecific molecule | QVTLKESGPVLVKPTETLTLTCTVSGFSLRNARMAVSWIRQPPGKTL EWLAHIFSNDEKSYSTSLKSRLTISKDTSKSQVVLTMTNMDPVDTAT YYCARIVGYGSGWYGYFDYWGQGTLVTVSSGGGGSGGGGSGGGGSDI QMTQSPSSVSASVGDRVTITCRASQDIRYDLAWYQQKPGKAPKRLIY AASSLQSGVPSRFSGSGSGTEFTLTISSLQPEDFATYYCLQHNFYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 388. | FL_5xCD3-scFc | Bispecific HLE molecule | QVTLKESGPVLVKPTETLTLTCTVSGFSLRNARMAVSWIRQPPGKTL EWLAHIFSNDEKSYSTSLKSRLTISKDTSKSQVVLTMTNMDPVDTAT YYCARIVGYGSGWYGYFDYWGQGTLVTVSSGGGGSGGGGSGGGGSDI QMTQSPSSVSASVGDRVTITCRASQDIRYDLAWYQQKPGKAPKRLIY AASSLQSGVPSRFSGSGSGTEFTLTISSLQPEDFATYYCLQHNFYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL |

TABLE 35-continued

| SEQ ID NO: | Designation | Format/ Source | Sequence |
|---|---|---|---|
| Sequence table | | | |
| | | | PPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 389. | FL_5_CCxCD3-scFc | VH | QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSS |
| 390. | FL_5_CCxCD3-scFc | VL | DIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIK |
| 391. | FL_5_CCxCD3-scFc | scFv | QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKS |
| 392. | FL_5_CCxCD3-scFc | Bispecific molecule | QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 393. | FL_5_CCxCD3-scFc | Bispecific HLE molecule | QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 394. | FL_6xCD3-scFc | VH CDR1 | NARMGVS |
| 395. | FL_6xCD3-scFc | VH CDR2 | HIFSNDEKSFSTSLKN |
| 396. | FL_6xCD3-scFc | VH CDR3 | MVGYGSGWYAYFDY |
| 397. | FL_6xCD3-scFc | VL CDR1 | RASQSISSYLN |
| 398. | FL_6xCD3-scFc | VL CDR2 | AASSLQS |
| 399. | FL_6xCD3-scFc | VL CDR3 | LQHNSYPLT |
| 400. | FL_6xCD3-scFc | VH | QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSS |

TABLE 35-continued

| SEQ ID NO: | Designation | Format/ Source | Sequence |
|---|---|---|---|
| | | | Sequence table |
| 401. | FL_6xCD3-scFc | VL | DIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIK |
| 402. | FL_6xCD3-scFc | scFv | QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKS |
| 403. | FL_6xCD3-scFc | Bispecific molecule | QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 404. | FL_6xCD3-scFc | Bispecific HLE molecule | QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 405. | FL_6_CCxCD3-scFc | VH | QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSS |
| 406. | FL_6_CCxCD3-scFc | VL | DIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIK |
| 407. | FL_6_CCxCD3-scFc | scFv | QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKS |
| 408. | FL_6_CCxCD3-scFc | Bispecific molecule | QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |

TABLE 35-continued

Sequence table

| SEQ ID NO: | Designation | Format/ Source | Sequence |
|---|---|---|---|
| 409. | FL_6_CCxCD3-scFc | Bispecific HLE molecule | QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 410. | FL_7xCD3-scFc | VH CDR1 | NARMGVS |
| 411. | FL_7xCD3-scFc | VH CDR2 | HIFSNDEKSYSTSLKN |
| 412. | FL_7xCD3-scFc | VH CDR3 | IVGYGTGWFGYFDY |
| 413. | FL_7xCD3-scFc | VL CDR1 | RASQDIRTDLA |
| 414. | FL_7xCD3-scFc | VL CDR2 | AASSLQS |
| 415. | FL_7xCD3-scFc | VL CDR3 | LQHNRYPLT |
| 416. | FL_7xCD3-scFc | VH | QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSS |
| 417. | FL_7xCD3-scFc | VL | DIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIK |
| 418. | FL_7xCD3-scFc | scFv | QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKS |
| 419. | FL_7xCD3-scFc | Bispecific molecule | QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 420. | FL_7xCD3-scFc | Bispecific HLE molecule | QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKSGGGGSEVQLVESGGGLVQPGGSLKLSCAASGFTFN |

TABLE 35-continued

| SEQ ID NO: | Designation | Format/ Source | Sequence |
|---|---|---|---|
| | | | KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 421. | FL_7_CCxCD 3-scFc | VH | QVTLKESGPTLVKPTETLTLTCTVSGFSLNNARMGVSWIRQPPGKCL EWLAHIFSNDEKSYSTSLKNRLTISKDSSKTQVVLTMTNVDPVDTAT YYCARIVGYGTGWFGYFDYWGQGTQVTVSS |
| 422. | FL_7_CCxCD 3-scFc | VL | DIQMTQSPSSLSASVGDRVTITCRASQDIRTDLAWYQQKPGKAPKRL IYAASSLQSGVPSRFSGSGSGTEFTLTISSLQPEDFATYYCLQHNRY PLTFGCGTKVDIK |
| 423. | FL_7_CCxCD 3-scFc | scFv | QVTLKESGPTLVKPTETLTLTCTVSGFSLNNARMGVSWIRQPPGKCL EWLAHIFSNDEKSYSTSLKNRLTISKDSSKTQVVLTMTNVDPVDTAT YYCARIVGYGTGWFGYFDYWGQGTQVTVSSGGGGSGGGGSGGGGSDI QMTQSPSSLSASVGDRVTITCRASQDIRTDLAWYQQKPGKAPKRLIY AASSLQSGVPSRFSGSGSGTEFTLTISSLQPEDFATYYCLQHNRYPL TFGCGTKVDIKS |
| 424. | FL_7_CCxCD 3-scFc | Bispecific molecule | QVTLKESGPTLVKPTETLTLTCTVSGFSLNNARMGVSWIRQPPGKCL EWLAHIFSNDEKSYSTSLKNRLTISKDSSKTQVVLTMTNVDPVDTAT YYCARIVGYGTGWFGYFDYWGQGTQVTVSSGGGGSGGGGSGGGGSDI QMTQSPSSLSASVGDRVTITCRASQDIRTDLAWYQQKPGKAPKRLIY AASSLQSGVPSRFSGSGSGTEFTLTISSLQPEDFATYYCLQHNRYPL TFGCGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 425. | FL_7_CCxCD 3-scFc | Bispecific HLE molecule | QVTLKESGPTLVKPTETLTLTCTVSGFSLNNARMGVSWIRQPPGKCL EWLAHIFSNDEKSYSTSLKNRLTISKDSSKTQVVLTMTNVDPVDTAT YYCARIVGYGTGWFGYFDYWGQGTQVTVSSGGGGSGGGGSGGGGSDI QMTQSPSSLSASVGDRVTITCRASQDIRTDLAWYQQKPGKAPKRLIY AASSLQSGVPSRFSGSGSGTEFTLTISSLQPEDFATYYCLQHNRYPL TFGCGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 426. | FL_8xCD3- scFc | VH CDR1 | NARMAVS |
| 427. | FL_8xCD3- scFc | VH CDR2 | HIFSNDEKSYSTSLKS |
| 428. | FL_8xCD3- scFc | VH CDR3 | IVGYGTGWYGFFDY |

TABLE 35-continued

Sequence table

| SEQ ID NO: | Designation | Format/ Source | Sequence |
|---|---|---|---|
| 429. | FL_8xCD3-scFc | VL CDR1 | RASQGIRNDLA |
| 430. | FL_8xCD3-scFc | VL CDR2 | AASSLQS |
| 431. | FL_8xCD3-scFc | VL CDR3 | LQHNSYPLT |
| 432. | FL_8xCD3-scFc | VH | QVTLKESGPALVKPTETLTLTCTLSGFSLNNARMAVSWIRQPPGKTL EWLAHIFSNDEKSYSTSLKSRLTISKDTSKSQVVLTMTNMDPEDTAT YYCARIVGYGTGWYGFFDYWGQGILVTVSS |
| 433. | FL_8xCD3-scFc | VL | DIQMTQSPSSLSASVGDRVTITCRASQGIRNDLAWYQQKPGKAPKRL IYAASSLQSGVPSRFSGSGSGTEFTLTISSLQPEDFATYYCLQHNSY PLTFGGGTKVEIK |
| 434. | FL_8xCD3-scFc | scFv | QVTLKESGPALVKPTETLTLTCTLSGFSLNNARMAVSWIRQPPGKTL EWLAHIFSNDEKSYSTSLKSRLTISKDTSKSQVVLTMTNMDPEDTAT YYCARIVGYGTGWYGFFDYWGQGILVTVSSGGGGSGGGGSGGGGSDI QMTQSPSSLSASVGDRVTITCRASQGIRNDLAWYQQKPGKAPKRLIY AASSLQSGVPSRFSGSGSGTEFTLTISSLQPEDFATYYCLQHNSYPL TFGGGTKVEIKS |
| 435. | FL_8xCD3-scFc | Bispecific molecule | QVTLKESGPALVKPTETLTLTCTLSGFSLNNARMAVSWIRQPPGKTL EWLAHIFSNDEKSYSTSLKSRLTISKDTSKSQVVLTMTNMDPEDTAT YYCARIVGYGTGWYGFFDYWGQGILVTVSSGGGGSGGGGSGGGGSDI QMTQSPSSLSASVGDRVTITCRASQGIRNDLAWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 436. | FL_8xCD3-scFc | Bispecific HLE molecule | QVTLKESGPALVKPTETLTLTCTLSGFSLNNARMAVSWIRQPPGKTL EWLAHIFSNDEKSYSTSLKSRLTISKDTSKSQVVLTMTNMDPEDTAT YYCARIVGYGTGWYGFFDYWGQGILVTVSSGGGGSGGGGSGGGGSDI QMTQSPSSLSASVGDRVTITCRASQGIRNDLAWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 437. | FL_8_CCxCD3-scFc | VH | QVTLKESGPALVKPTETLTLTCTLSGFSLNNARMAVSWIRQPPGKCL EWLAHIFSNDEKSYSTSLKSRLTISKDTSKSQVVLTMTNMDPEDTAT YYCARIVGYGTGWYGFFDYWGQGILVTVSS |
| 438. | FL_8_CCxCD3-scFc | VL | DIQMTQSPSSLSASVGDRVTITCRASQGIRNDLAWYQQKPGKAPKRL IYAASSLQSGVPSRFSGSGSGTEFTLTISSLQPEDFATYYCLQHNSY PLTFGCGTKVEIK |
| 439. | FL_8_CCxCD3-scFc | scFv | QVTLKESGPALVKPTETLTLTCTLSGFSLNNARMAVSWIRQPPGKCL EWLAHIFSNDEKSYSTSLKSRLTISKDTSKSQVVLTMTNMDPEDTAT YYCARIVGYGTGWYGFFDYWGQGILVTVSSGGGGSGGGGSGGGGSDI QMTQSPSSLSASVGDRVTITCRASQGIRNDLAWYQQKPGKAPKRLIY AASSLQSGVPSRFSGSGSGTEFTLTISSLQPEDFATYYCLQHNSYPL TFGCGTKVEIKS |

TABLE 35-continued

| SEQ ID NO: | Designation | Format/ Source | Sequence |
|---|---|---|---|
| Sequence table | | | |
| 440. | FL_8_CCxCD 3-scFc | Bispecific molecule | QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 441. | FL_8_CCxCD 3-scFc | Bispecific HLE molecule | QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 442. | FL_9xCD3-scFc | VH CDR1 | YARMGVS |
| 443. | FL_9xCD3-scFc | VH CDR2 | HIFSNDEKSYSTSLKS |
| 444. | FL_9xCD3-scFc | VH CDR3 | MPEYSSGWSGAFDI |
| 445. | FL_9xCD3-scFc | VL CDR1 | RASQDIRNDLA |
| 446. | FL_9xCD3-scFc | VL CDR2 | AASSLQS |
| 447. | FL_9xCD3-scFc | VL CDR3 | LQHNSYPLT |
| 448. | FL_9xCD3-scFc | VH | QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSS |
| 449. | FL_9xCD3-scFc | VL | DIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIK |
| 450. | FL_9xCD3-scFc | scFv | QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKS |
| 451. | FL_9xCD3-scFc | Bispecific molecule | QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDS |

TABLE 35-continued

| SEQ ID NO: | Designation | Format/ Source | Sequence |
|---|---|---|---|
| | | | KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 452. | FL_9xCD3-scFc | Bispecific HLE molecule | QVTLKESGPTLVKPTETLTLTCTFSGFSLRYARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRNDLAWYQQKPGKAPKRLIY AASSLQSGVPSRFSGSGSGTEFTLTISSLQPEDFATYYCLQHNSYPL TFGGGTKLEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 453. | FL_9_CCxCD3-scFc | VH | QVTLKESGPTLVKPTETLTLTCTFSGFSLRYARMGVSWIRQPPGKCL EWLAHIFSNDEKSYSTSLKSRLTISKDTSKSQVVLTLTNMDPVDTAT YFCARMPEYSSGWSGAFDIWGQGTMVTVSS |
| 454. | FL_9_CCxCD3-scFc | VL | DIQMTQSPSSLSASVGDRVTITCRASQDIRNDLAWYQQKPGKAPKRL IYAASSLQSGVPSRFSGSGSGTEFTLTISSLQPEDFATYYCLQHNSY PLTFGCGTKLEIK |
| 455. | FL_9_CCxCD3-scFc | scFv | QVTLKESGPTLVKPTETLTLTCTFSGFSLRYARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRNDLAWYQQKPGKAPKRLIY AASSLQSGVPSRFSGSGSGTEFTLTISSLQPEDFATYYCLQHNSYPL TFGCGTKLEIKS |
| 456. | FL_9_CCxCD3-scFc | Bispecific molecule | QVTLKESGPTLVKPTETLTLTCTFSGFSLRYARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRNDLAWYQQKPGKAPKRLIY AASSLQSGVPSRFSGSGSGTEFTLTISSLQPEDFATYYCLQHNSYPL TFGCGTKLEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 457. | FL_9_CCxCD3-scFc | Bispecific HLE molecule | QVTLKESGPTLVKPTETLTLTCTFSGFSLRYARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRNDLAWYQQKPGKAPKRLIY AASSLQSGVPSRFSGSGSGTEFTLTISSLQPEDFATYYCLQHNSYPL TFGCGTKLEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL |

TABLE 35-continued

| SEQ ID NO: | Designation | Format/ Source | Sequence |
|---|---|---|---|
| | | | DSDGSFFLYSKLTVDKSRWQQGNVFSCSVMHEALHNHYTQKSLSLSP GK |
| 458. | FL_10xCD3-scFc | VH CDR1 | NARMGVS |
| 459. | FL_10xCD3-scFc | VH CDR2 | HIFSNDEKSYSTSLKS |
| 460. | FL_10xCD3-scFc | VH CDR3 | MPEYSSGWSGAFDI |
| 461. | FL_10xCD3-scFc | VL CDR1 | RASQDIRDDLG |
| 462. | FL_10xCD3-scFc | VL CDR2 | GASTLQS |
| 463. | FL_10xCD3-scFc | VL CDR3 | LQHNSYPLT |
| 464. | FL_10xCD3-scFc | VH | QVTLKESGPVLVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSS |
| 465. | FL_10xCD3-scFc | VL | DIQMTQSPSSLSASVGDRVTITCRASQDIRDDLGWYQQKPGNAPKRL IYGASTLQSGVPSRFSGSGSGTEFTLTISSLQPEDFATYYCLQHNSY PLTFGGGTKVDIK |
| 466. | FL_10xCD3-scFc | scFv | QVTLKESGPVLVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGGGTKVDIKS |
| 467. | FL_10xCD3-scFc | Bispecific molecule | QVTLKESGPVLVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGGGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 468. | FL_10xCD3-scFc | Bispecific HLE molecule | QVTLKESGPVLVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGGGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 469. | FL_10_CCxCD3-scFc | VH | QVTLKESGPVLVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSS |

TABLE 35-continued

Sequence table

| SEQ ID NO: | Designation | Format/ Source | Sequence |
|---|---|---|---|
| 470. | FL_10_CCxC D3-scFc | VL | DIQMTQSPSSLSASVGDRVTITCRASQDIRDDLGWYQQKPGNAPKRL IYGASTLQSGVPSRFSGSGSGTEFTLTISSLQPEDFATYYCLQHNSY PLTFGCGTKVDIK |
| 471. | FL_10_CCxC D3-scFc | scFv | QVTLKESGPVLVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGCGTKVDIKS |
| 472. | FL_10_CCxC D3-scFc | Bispecific molecule | QVTLKESGPVLVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGCGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 473. | FL_10_CCxC D3-scFc | Bispecific HLE molecule | QVTLKESGPVLVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGCGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 474. | FL_11xCD3-scFc | VH CDR1 | NARMGVS |
| 475. | FL_11xCD3-scFc | VH CDR2 | HIFSNDEKSYSTSLKS |
| 476. | FL_11xCD3-scFc | VH CDR3 | MPEYSSGWSGAFDI |
| 477. | FL_11xCD3-scFc | VL CDR1 | RASQDIGYDLG |
| 478. | FL_11xCD3-scFc | VL CDR2 | AASTLQS |
| 479. | FL_11xCD3-scFc | VL CDR3 | LQHNSFPWT |
| 480. | FL_11xCD3-scFc | VH | QVTLKESGPALVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSS |
| 481. | FL_11xCD3-scFc | VL | DIQMTQSPSSLSASVGDRVTITCRASQDIGYDLGWYQQKPGKAPKRL IYAASTLQSGVPSRFSGSGSGTEFTLIISSLQPEDFATYYCLQHNSF PWTFGQGTKVEIK |
| 482. | FL_11xCD3-scFc | scFv | QVTLKESGPALVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI |

TABLE 35-continued

| SEQ ID NO: | Designation | Format/ Source | Sequence |
|---|---|---|---|
| | | | QMTQSPSSLSASVGDRVTITCRASQDIGYDLGWYQQKPGKAPKRLIY AASTLQSGVPSRFSGSGSGTEFTLIISSLQPEDFATYYCLQHNSFPW TFGQGTKVEIKS |
| 483. | FL_11xCD3-scFc | Bispecific molecule | QVTLKESGPALVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIGYDLGWYQQKPGKAPKRLIY AASTLQSGVPSRFSGSGSGTEFTLIISSLQPEDFATYYCLQHNSFPW TFGQGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 484. | FL_11xCD3-scFc | Bispecific HLE molecule | QVTLKESGPALVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIGYDLGWYQQKPGKAPKRLIY AASTLQSGVPSRFSGSGSGTEFTLIISSLQPEDFATYYCLQHNSFPW TFGQGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 485. | FL_11_CCxCD3-scFc | VH | QVTLKESGPALVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSS |
| 486. | FL_11_CCxCD3-scFc | VL | DIQMTQSPSSLSASVGDRVTITCRASQDIGYDLGWYQQKPGKAPKRL IYAASTLQSGVPSRFSGSGSGTEFTLIISSLQPEDFATYYCLQHNSF PWTFGCGTKVEIK |
| 487. | FL_11_CCxCD3-scFc | scFv | QVTLKESGPALVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIGYDLGWYQQKPGKAPKRLIY AASTLQSGVPSRFSGSGSGTEFTLIISSLQPEDFATYYCLQHNSFPW TFGCGTKVEIKS |
| 488. | FL_11_CCxCD3-scFc | Bispecific molecule | QVTLKESGPALVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIGYDLGWYQQKPGKAPKRLIY AASTLQSGVPSRFSGSGSGTEFTLIISSLQPEDFATYYCLQHNSFPW TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 489. | FL_11_CCxCD3-scFc | Bispecific HLE molecule | QVTLKESGPALVKPTETLTLTCTVSGFSFRNARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIGYDLGWYQQKPGKAPKRLIY AASTLQSGVPSRFSGSGSGTEFTLIISSLQPEDFATYYCLQHNSFPW TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS |

TABLE 35-continued

| Sequence table | | | |
|---|---|---|---|
| SEQ ID NO: | Designation | Format/ Source | Sequence |
| | | | GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 490. | FL_12xCD3-scFc | VH CDR1 | NARMGVS |
| 491. | FL_12xCD3-scFc | VH CDR2 | HIFSNDEKSYRTSLKS |
| 492. | FL_12xCD3-scFc | VH CDR3 | IVGYGSGWYAYFDY |
| 493. | FL_12xCD3-scFc | VL CDR1 | RASQGIRNDLG |
| 494. | FL_12xCD3-scFc | VL CDR2 | AASSLQS |
| 495. | FL_12xCD3-scFc | VL CDR3 | LQHNSYPLT |
| 496. | FL_12xCD3-scFc | VH | QVTLKESGPALVKPTQTLTLTCTFSGFSLSNARMGVSWIRQPPGKAL EWLAHIFSNDEKSYRTSLKSRLTISKDTSKSQVVLTMTNMDPVDTAT YYCARIVGYGSGWYAYFDYWGQGTLVTVSS |
| 497. | FL_12xCD3-scFc | VL | DIQMTQSPSSLSASVGDRVTITCRASQGIRNDLGWYQQKPGKAPKRL IYAASSLQSGVPSRFSGSGSGTEFTLTISSLQPEDFATYYCLQHNSY PLTFGGGTKVEIK |
| 498. | FL_12xCD3-scFc | scFv | QVTLKESGPALVKPTQTLTLTCTFSGFSLSNARMGVSWIRQPPGKAL EWLAHIFSNDEKSYRTSLKSRLTISKDTSKSQVVLTMTNMDPVDTAT YYCARIVGYGSGWYAYFDYWGQGTLVTVSSGGGGSGGGGSGGGGSDI QMTQSPSSLSASVGDRVTITCRASQGIRNDLGWYQQKPGKAPKRLIY AASSLQSGVPSRFSGSGSGTEFTLTISSLQPEDFATYYCLQHNSYPL TFGGGTKVEIKS |
| 499. | FL_12xCD3-scFc | Bispecific molecule | QVTLKESGPALVKPTQTLTLTCTFSGFSLSNARMGVSWIRQPPGKAL EWLAHIFSNDEKSYRTSLKSRLTISKDTSKSQVVLTMTNMDPVDTAT YYCARIVGYGSGWYAYFDYWGQGTLVTVSSGGGGSGGGGSGGGGSDI QMTQSPSSLSASVGDRVTITCRASQGIRNDLGWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 500. | FL_12xCD3-scFc | Bispecific HLE molecule | QVTLKESGPALVKPTQTLTLTCTFSGFSLSNARMGVSWIRQPPGKAL EWLAHIFSNDEKSYRTSLKSRLTISKDTSKSQVVLTMTNMDPVDTAT YYCARIVGYGSGWYAYFDYWGQGTLVTVSSGGGGSGGGGSGGGGSDI QMTQSPSSLSASVGDRVTITCRASQGIRNDLGWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS |

TABLE 35-continued

| SEQ ID NO: | Designation | Format/ Source | Sequence |
|---|---|---|---|
| | | | GGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 501. | FL_12_CCxCD3-scFc | VH | QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSS |
| 502. | FL_12_CCxCD3-scFc | VL | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIK |
| 503. | FL_12_CCxCD3-scFc | scFv | QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKS |
| 504. | FL_12_CCxCD3-scFc | Bispecific molecule | QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 505. | FL_12_CCxCD3-scFc | Bispecific HLE molecule | QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 506. | FL_13xCD3-scFc | VH CDR1 | NARMGVS |
| 507. | FL_13xCD3-scFc | VH CDR2 | LIYWNDDKRYSPSLKS |
| 508. | FL_13xCD3-scFc | VH CDR3 | MVGYGSGWYAYFDY |
| 509. | FL_13xCD3-scFc | VL CDR1 | RASQGIRNDLG |
| 510. | FL_13xCD3-scFc | VL CDR2 | AASSLQS |
| 511. | FL_13xCD3-scFc | VL CDR3 | LQHNSYPLT |

TABLE 35-continued

| Sequence table | | | |
|---|---|---|---|
| SEQ ID NO: | Designation | Format/ Source | Sequence |
| 512. | FL_13xCD3-scFc | VH | QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSS |
| 513. | FL_13xCD3-scFc | VL | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK |
| 514. | FL_13xCD3-scFc | scFv | QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKS |
| 515. | FL_13xCD3-scFc | Bispecific molecule | QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 516. | FL_13xCD3-scFc | Bispecific HLE molecule | QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 517. | FL_13_CCxCD3-scFc | VH | QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSS |
| 518. | FL_13_CCxCD3-scFc | VL | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIK |
| 519. | FL_13_CCxCD3-scFc | scFv | QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKS |
| 520. | FL_13_CCxCD3-scFc | Bispecific molecule | QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPL |

TABLE 35-continued

Sequence table

| SEQ ID NO: | Designation | Format/ Source | Sequence |
|---|---|---|---|
| | | | TFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 521. | FL_13_CCxCD3-scFc | Bispecific HLE molecule | QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 522. | FL_14xCD3-scFc | VH CDR1 | NARMGVS |
| 523. | FL_14xCD3-scFc | VH CDR2 | HIFSNDEKSYSTSLKS |
| 524. | FL_14xCD3-scFc | VH CDR3 | IVGYGTGWYGFFDY |
| 525. | FL_14xCD3-scFc | VL CDR1 | RTSQGIRNDLG |
| 526. | FL_14xCD3-scFc | VL CDR2 | AASSLQS |
| 527. | FL_14xCD3-scFc | VL CDR3 | LQHNSYPLT |
| 528. | FL_14xCD3-scFc | VH | QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSS |
| 529. | FL_14xCD3-scFc | VL | DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIK |
| 530. | FL_14xCD3-scFc | scFv | QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKS |
| 531. | FL_14xCD3-scFc | Bispecific molecule | QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |

TABLE 35-continued

Sequence table

| SEQ ID NO: | Designation | Format/ Source | Sequence |
|---|---|---|---|
| 532. | FL_14xCD3-scFc | Bispecific HLE molecule | QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 533. | FL_14_CCxCD3-scFc | VH | QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSS |
| 534. | FL_14_CCxCD3-scFc | VL | DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIK |
| 535. | FL_14_CCxCD3-scFc | scFv | QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKS |
| 536. | FL_14_CCxCD3-scFc | Bispecific molecule | QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 537. | FL_14_CCxCD3-scFc | Bispecific HLE molecule | QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 538. | FL_15xCD3-scFc | VH CDR1 | SYGMH |
| 539. | FL_15xCD3-scFc | VH CDR2 | VISYEGSNEFYAESVKG |
| 540. | FL_15xCD3-scFc | VH CDR3 | GGEITMVRGVIGYYYYGMDV |
| 541. | FL_15xCD3-scFc | VL CDR1 | RASQSISSYLN |
| 542. | FL_15xCD3-scFc | VL CDR2 | AASSLQS |
| 543. | FL_15xCD3-scFc | VL CDR3 | LQHNSYPLT |
| 544. | FL_15xCD3-scFc | VH | QVQLVESGGGVVQPGRSLRLSCAASGFTFSSYGMHWVRQAPGKGLEW VAVISYEGSNEFYAESVKGRFTISRDNSKNTLYLQMNSLRAEDTAVY YCARGGEITMVRGVIGYYYYGMDVWGQGTTVTVSS |
| 545. | FL_15xCD3-scFc | VL | DIQMTQSPSSLSASVGDRVTITCRASQSISSYLNWYQQKPGKAPKLL IYAASSLQSGVPSRFSGSGSGTEFTLTISSLQPEDFATYYCLQHNSY PLTFGGGTKVEIK |
| 546. | FL_15xCD3-scFc | scFv | QVQLVESGGGVVQPGRSLRLSCAASGFTFSSYGMHWVRQAPGKGLEW VAVISYEGSNEFYAESVKGRFTISRDNSKNTLYLQMNSLRAEDTAVY YCARGGEITMVRGVIGYYYYGMDVWGQGTTVTVSSGGGGSGGGGSGG GGSDIQMTQSPSSLSASVGDRVTITCRASQSISSYLNWYQQKPGKAP KLLIYAASSLQSGVPSRFSGSGSGTEFTLTISSLQPEDFATYYCLQH NSYPLTFGGGTKVEIKS |
| 547. | FL_15xCD3-scFc | Bispecific molecule | QVQLVESGGGVVQPGRSLRLSCAASGFTFSSYGMHWVRQAPGKGLEW VAVISYEGSNEFYAESVKGRFTISRDNSKNTLYLQMNSLRAEDTAVY YCARGGEITMVRGVIGYYYYGMDVWGQGTTVTVSSGGGGSGGGGSGG GGSDIQMTQSPSSLSASVGDRVTITCRASQSISSYLNWYQQKPGKAP KLLIYAASSLQSGVPSRFSGSGSGTEFTLTISSLQPEDFATYYCLQH NSYPLTFGGGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVL |
| 548. | FL_15xCD3-scFc | Bispecific HLE molecule | QVQLVESGGGVVQPGRSLRLSCAASGFTFSSYGMHWVRQAPGKGLEW VAVISYEGSNEFYAESVKGRFTISRDNSKNTLYLQMNSLRAEDTAVY YCARGGEITMVRGVIGYYYYGMDVWGQGTTVTVSSGGGGSGGGGSGG GGSDIQMTQSPSSLSASVGDRVTITCRASQSISSYLNWYQQKPGKAP KLLIYAASSLQSGVPSRFSGSGSGTEFTLTISSLQPEDFATYYCLQH NSYPLTFGGGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGKGGGGSGGGGSGGGGS GGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGST YRCVSVLTVLHQDWLNGKEYKCKVSNKALPAPIEKTISKAKGQPREP QVYTLPPSREEMTKNQVSLTCLVKGFYPSDIAVEWESNGQPENNYKT TPPVLDSDGSFFLYSKLTVDKSRWQQGNVFSCSVMHEALHNHYTQKS LSLSPGK |
| 549. | FL_15_CCxCD3-scFc | VH | QVQLVESGGGVVQPGRSLRLSCAASGFTFSSYGMHWVRQAPGKCLEW VAVISYEGSNEFYAESVKGRFTISRDNSKNTLYLQMNSLRAEDTAVY YCARGGE1TMVRGVIGYYYYGMDVWGQGTTVTVSS |

TABLE 35-continued

Sequence table

| SEQ ID NO: | Designation | Format/ Source | Sequence |
|---|---|---|---|
| 550. | FL_15_CCxCD3-scFc | VL | DIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIK |
| 551. | FL_15_CCxCD3-scFc | scFv | QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKS |
| 552. | FL_15_CCxCD3-scFc | Bispecific molecule | QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 553. | FL_15_CCxCD3-scFc | Bispecific HLE molecule | QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 554. | FL_1xCD3-scFc_delGK | Bispecific HLE molecule | QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 555. | FL_1_CCxCD3-scFc_delGK | Bispecific HLE molecule | QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFN |

TABLE 35-continued

Sequence table

| SEQ ID NO: | Designation | Format/ Source | Sequence |
|---|---|---|---|
| | | | KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 556. | FL_2xCD3-scFc_delGK | Bispecific HLE molecule | QVTLKESGPTLVKPTETLTLTCTLSGFSLNNARMGVSWIRQPPGKAL<br>EWLAHIFSNDEKSYSTSLKNRLTISKDSSKTQVVLTMTNVDPVDTAT<br>YYCARIVGYGSGWYGFFDYWGQGTLVTVSSGGGGSGGGGSGGGGSDI<br>QMTQSPSSLSASVGDRVTITCRASQGIRNDLGWYQQKPGKAPKRLIY<br>AASTLQSGVPSRFSGSGSGTEFTLTISSLQPEDFATYYCLQHNSYPL<br>TFGGGTKVEIKSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 557. | FL_2_CCxCD 3-scFc_delGK | Bispecific HLE molecule | QVTLKESGPTLVKPTETLTLTCTLSGFSLNNARMGVSWIRQPPGKCL<br>EWLAHIFSNDEKSYSTSLKNRLTISKDSSKTQVVLTMTNVDPVDTAT<br>YYCARIVGYGSGWYGFFDYWGQGTLVTVSSGGGGSGGGGSGGGGSDI<br>QMTQSPSSLSASVGDRVTITCRASQGIRNDLGWYQQKPGKAPKRLIY<br>AASTLQSGVPSRFSGSGSGTEFTLTISSLQPEDFATYYCLQHNSYPL<br>TFGCGTKVEIKSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 558. | FL_3xCD3-scFc_delGK | Bispecific HLE molecule | QVTLKESGPALVKPTETLTLTCTLSGFSLNNARMAVSWIRQPPGKTL<br>EWLAHIFSNDEKSYSTSLKSRLTISKDTSKGQVVLTMTNMDPVDTAT<br>YYCARIVGYGSGWYGYFDYWGQGTLVTVSSGGGGSGGGGSGGGGSDI<br>QMTQSPSSLSASVGDRVTITCRASQDIRNDLGWYQQKPGKAPKRLIY<br>AASTLQSGVPSRFSGSGSGTEFTLTISSLQPEDFATYYCLQHNSYPL<br>TFGGGTKVEIKSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG |

TABLE 35-continued

Sequence table

| SEQ ID NO: | Designation | Format/ Source | Sequence |
|---|---|---|---|
| | | | NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 559. | FL_3_CCxCD 3-scFc_delGK | Bispecific HLE molecule | QVTLKESGPALVKPTETLTLTCTLSGFSLNNARMAVSWIRQPPGKCL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRNDLGWYQQKPGKAPKRLIY AASTLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 560. | FL_4xCD3- scFc_delGK | Bispecific HLE molecule | QVTLKESGPALVKPTETLTLTCTLSGFSLNNAKMGVSWIRQPPGKAL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGGGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 561. | FL_4_CCxCD 3-scFc_delGK | Bispecific HLE molecule | QVTLKESGPALVKPTETLTLTCTLSGFSLNNAKMGVSWIRQPPGKCL EWLAHIFSNDEKSYSTSLKSRLTISKDTSKGQVVLTMTNMDPVDTAT YYCARIVGYGSGWYGYFDYWGQGTLVTVSSGGGGSGGGGSGGGGSDI QMTQSPSSLSASVGDRVTITCRASQDIRDDLGWYQQKPGNAPKRLIY GASTLQSGVPSRFSGSGSGTEFTLTISSLQPEDFATYYCLQHNSYPL TFGCGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| 562. | FL_5xCD3-scFc_delGK | Bispecific HLE molecule | QVTLKESGPVLVKPTETLTLTCTVSGFSLRNARMAVSWIRQPPGKTL EWLAHIFSNDEKSYSTSLKSRLTISKDTSKSQVVLTMTNMDPVDTAT YYCARIVGYGSGWYGYFDYWGQGTLVTVSSGGGGSGGGGSGGGGSDI QMTQSPSSVSASVGDRVTITCRASQDIRYDLAWYQQKPGKAPKRLIY AASSLQSGVPSRFSGSGSGTEFTLTISSLQPEDFATYYCLQHNFYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 563. | FL_5_CCxCD3-scFc_delGK | Bispecific HLE molecule | QVTLKESGPVLVKPTETLTLTCTVSGFSLRNARMAVSWIRQPPGKCL EWLAHIFSNDEKSYSTSLKSRLTISKDTSKSQVVLTMTNMDPVDTAT YYCARIVGYGSGWYGYFDYWGQGTLVTVSSGGGGSGGGGSGGGGSDI QMTQSPSSVSASVGDRVTITCRASQDIRYDLAWYQQKPGKAPKRLIY AASSLQSGVPSRFSGSGSGTEFTLTISSLQPEDFATYYCLQHNFYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 564. | FL_6xCD3-scFc_delGK | Bispecific HLE molecule | QVTLKESGPVLVKPTQTLTLTCTFSGFSLSNARMGVSWIRQPPGKAL EWLAHIFSNDEKSFSTSLKNRLTISKDTSKSQVVLTMTNMDPVDTAT YYCARMVGYGSGWYAYFDYWGQGTQVTVSSGGGGSGGGGSGGGGSDI QMTQSPSSLSASVGDRVTITCRASQSISSYLNWYQQKPGKAPKLLIY AASSLQSGVPSRFSGSGSGTDFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 565. | FL_6_CCxCD3-scFc_delGK | Bispecific HLE molecule | QVTLKESGPVLVKPTQTLTLTCTFSGFSLSNARMGVSWIRQPPGKCL EWLAHIFSNDEKSFSTSLKNRLTISKDTSKSQVVLTMTNMDPVDTAT YYCARMVGYGSGWYAYFDYWGQGTQVTVSSGGGGSGGGGSGGGGSDI QMTQSPSSLSASVGDRVTITCRASQSISSYLNWYQQKPGKAPKLLIY AASSLQSGVPSRFSGSGSGTDFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS |

TABLE 35-continued

| Sequence table | | | |
|---|---|---|---|
| SEQ ID NO: | Designation | Format/ Source | Sequence |
| | | | SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 566. | FL_7xCD3-scFc_delGK | Bispecific HLE molecule | QVTLKESGPTLVKPTETLTLTCTVSGFSLNNARMGVSWIRQPPGKAL EWLAHIFSNDEKSYSTSLKNRLTISKDSSKTQVVLTMTNVDPVDTAT YYCARIVGYGTGWFGYFDYWGQGTQVTVSSGGGGSGGGGSGGGGSDI QMTQSPSSLSASVGDRVTITCRASQDIRTDLAWYQQKPGKAPKRLIY AASSLQSGVPSRFSGSGSGTEFTLTISSLQPEDFATYYCLQHNRYPL TFGGGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 567. | FL_7_CCxCD 3-scFc_delGK | Bispecific HLE molecule | QVTLKESGPTLVKPTETLTLTCTVSGFSLNNARMGVSWIRQPPGKCL EWLAHIFSNDEKSYSTSLKNRLTISKDSSKTQVVLTMTNVDPVDTAT YYCARIVGYGTGWFGYFDYWGQGTQVTVSSGGGGSGGGGSGGGGSDI QMTQSPSSLSASVGDRVTITCRASQDIRTDLAWYQQKPGKAPKRLIY AASSLQSGVPSRFSGSGSGTEFTLTISSLQPEDFATYYCLQHNRYPL TFGCGTKVDIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 568. | FL_8xCD3-scFc_delGK | Bispecific HLE molecule | QVTLKESGPALVKPTETLTLTCTLSGFSLNNARMAVSWIRQPPGKTL EWLAHIFSNDEKSYSTSLKSRLTISKDTSKSQVVLTMTNMDPEDTAT YYCARIVGYGTGWYGFFDYWGQGILVTVSSGGGGSGGGGSGGGGSDI QMTQSPSSLSASVGDRVTITCRASQGIRNDLAWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV |

TABLE 35-continued

| SEQ ID NO: | Designation | Format/ Source | Sequence |
|---|---|---|---|
| | | | TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 569. | FL_8_CCxCD 3-scFc_delGK | Bispecific HLE molecule | QVTLKESGPALVKPTETLTLTCTLSGFSLNNARMAVSWIRQPPGKCL EWLAHIFSNDEKSYSTSLKSRLTISKDTSKSQVVLTMTNMDPEDTAT YYCARIVGYGTGWYGFFDYWGQGILVTVSSGGGGSGGGGSGGGGSDI QMTQSPSSLSASVGDRVTITCRASQGIRNDLAWYQQKPGKAPKRLIY AASSLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 570. | FL_9xCD3- scFc_delGK | Bispecific HLE molecule | QVTLKESGPTLVKPTETLTLTCTFSGFSLRYARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRNDLAWYQQKPGKAPKRLIY AASSLQSGVPSRFSGSGSGTEFTLTISSLQPEDFATYYCLQHNSYPL TFGGGTKLEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 571. | FL_9_CCxCD 3-scFc_delGK | Bispecific HLE molecule | QVTLKESGPTLVKPTETLTLTCTFSGFSLRYARMGVSWIRQPPGKCL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRNDLAWYQQKPGKAPKRLIY AASSLQSGVPSRFSGSGSGTEFTLTISSLQPEDFATYYCLQHNSYPL TFGCGTKLEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 572. | FL_10xCD3- scFc_delGK | Bispecific HLE molecule | QVTLKESGPVLVKPTETLTLTCTVSGFSFRNARMGVSWIRQPPGKAL EWLAHIFSNDEKSYSTSLKSRLTISKDTSKSQVVLTLTNMDPVDTAT YFCARMPEYSSGWSGAFDIWGQGTMVTVSSGGGGSGGGGSGGGGSDI QMTQSPSSLSASVGDRVTITCRASQDIRDDLGWYQQKPGNAPKRLIY |

TABLE 35-continued

Sequence table

| SEQ ID NO: | Designation | Format/ Source | Sequence |
|---|---|---|---|
| | | | GASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 573. | FL_10_CCxCD3-scFc_delGK | Bispecific HLE molecule | QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 574. | FL_11xCD3-scFc_delGK | Bispecific HLE molecule | QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 575. | FL_11_CCxCD3-scFc_delGK | Bispecific HLE molecule | QVTLKESGPALVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNK |

TABLE 35-continued

| SEQ ID NO: | Designation | Format/ Source | Sequence |
|---|---|---|---|
| | Sequence table | | |
| | | | ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 576. | FL_12xCD3-scFc_delGK | Bispecific HLE molecule | QVTLKESGPALVKPTQTLTLTCTFSGFSLSNARMGVSWIRQPPGKAL EWLAHIFSNDEKSYRTSLKSRLTISKDTSKSQVVLTMTNMDPVDTAT YYCARIVGYGSGWYAYFDYWGQGTLVTVSSGGGGSGGGGSGGGGSDI QMTQSPSSLSASVGDRVTITCRASQGIRNDLGWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 577. | FL_12_CCxCD3-scFc_delGK | Bispecific HLE molecule | QVTLKESGPALVKPTQTLTLTCTFSGFSLSNARMGVSWIRQPPGKCL EWLAHIFSNDEKSYRTSLKSRLTISKDTSKSQVVLTMTNMDPVDTAT YYCARIVGYGSGWYAYFDYWGQGTLVTVSSGGGGSGGGGSGGGGSDI QMTQSPSSLSASVGDRVTITCRASQGIRNDLGWYQQKPGKAPKRLIY AASSLQSGVPSRFSGSGSGTEFTLTISSLQPEDFATYYCLQHNSYPL TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 578. | FL_13xCD3-scFc_delGK | Bispecific HLE molecule | QVTLKESGPVLVKPTQTLTLTCTFSGFSLSNARMGVSWIRQPPGKAL EWLALIYWNDDKRYSPSLKSRLTITKDTSKNQVVLTMTNMDPVDTAT YYCARMVGYGSGWYAYFDYWGQGTLVTVSSGGGGSGGGGSGGGGSDI QMTQSPSSLSASVGDRVTITCRASQGIRNDLGWYQQKPGKAPKRLIY AASSLQSGVPSRFSGSGSGTEFTLTISSLQPEDFATYYCLQHNSYPL TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 579. | FL_13_CCxCD3-scFc_delGK | Bispecific HLE molecule | QVTLKESGPVLVKPTQTLTLTCTFSGFSLSNARMGVSWIRQPPGKCL<br>EWLALIYWNDDKRYSPSLKSRLTITKDTSKNQVVLTMTNMDPVDTAT<br>YYCARMVGYGSGWYAYFDYWGQGTLVTVSSGGGGSGGGGSGGGGSDI<br>QMTQSPSSLSASVGDRVTITCRASQGIRNDLGWYQQKPGKAPKRLIY<br>AASSLQSGVPSRFSGSGSGTEFTLTISSLQPEDFATYYCLQHNSYPL<br>TFGCGTKVEIKSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 580. | FL_14xCD3-scFc_delGK | Bispecific HLE molecule | QVTLKESGPALVKPTQTLTLTCTFSGFSLSNARMGVSWIRQPPGKAL<br>EWLAHIFSNDEKSYSTSLKSRLTISKDTSKSQVVLTMTDMDPEDTAT<br>YYCARIVGYGTGWYGFFDYWGQGILVTVSSGGGGSGGGGSGGGGSDI<br>QMTQSPSSLSASVGDRVTITCRTSQGIRNDLGWYQQKPGKAPKRLIY<br>AASSLQSGVPSRFSGSGSGTEFTLTISSLQPEDFATYYCLQHNSYPL<br>TFGGGTKVEIKSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 581. | FL_14_CCxCD3-scFc_delGK | Bispecific HLE molecule | QVTLKESGPALVKPTQTLTLTCTFSGFSLSNARMGVSWIRQPPGKCL<br>EWLAHIFSNDEKSYSTSLKSRLTISKDTSKSQVVLTMTDMDPEDTAT<br>YYCARIVGYGTGWYGFFDYWGQGILVTVSSGGGGSGGGGSGGGGSDI<br>QMTQSPSSLSASVGDRVTITCRTSQGIRNDLGWYQQKPGKAPKRLIY<br>AASSLQSGVPSRFSGSGSGTEFTLTISSLQPEDFATYYCLQHNSYPL<br>TFGCGTKVEIKSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 582. | FL_15xCD3-scFc_delGK | Bispecific HLE molecule | QVQLVESGGGVVQPGRSLRLSCAASGFTFSSYGMHWVRQAPGKGLEW<br>VAVISYEGSNEFYAESVKGRFTISRDNSKNTLYLQMNSLRAEDTAVY<br>YCARGGEITMVRGVIGYYYYGMDVWGQGTTVTVSSGGGGSGGGGSGG<br>GGSDIQMTQSPSSLSASVGDRVTITCRASQSISSYLNWYQQKPGKAP<br>KLLIYAASSLQSGVPSRFSGSGSGTEFTLTISSLQPEDFATYYCLQH<br>NSYPLTFGGGTKVEIKSGGGGSEVQLVESGGGLVQPGGSLKLSCAAS<br>GFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGT<br>LVTVSSGGGGSGGGGSGGGGSQTVVTQEPSLTVSPGGTVTLTCGSST |

TABLE 35-continued

| SEQ ID NO: | Designation | Format/ Source | Sequence |
|---|---|---|---|
| | | | GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGGGGSGGGGSGGGGSGG GGSGGGGSGGGGSDKTHTCPPCPAPELLGGPSVFLFPPKPKDTLMIS RTPEVTCVVVDVSHEDPEVKFNWYVDGVEVHNAKTKPCEEQYGSTYR CVSVLTVLHQDWLNGKEYKCKVSNKALPAPIEKTISKAKGQPREPQV YTLPPSREEMTKNQVSLTCLVKGFYPSDIAVEWESNGQPENNYKTTP PVLDSDGSFFLYSKLTVDKSRWQQGNVFSCSVMHEALHNHYTQKSLS LSPGK |
| 583. | FL_15_CCxC D3-scFc_delGK | Bispecific HLE molecule | QVQLVESGGGVVQPGRSLRLSCAASGFTFSSYGMHWVRQAPGKCLEW VAVISYEGSNEFYAESVKGRFTISRDNSKNTLYLQMNSLRAEDTAVY YCARGGEITMVRGVIGYYYYGMDVWGQGTTVTVSSGGGGSGGGGSGG GGSDIQMTQSPSSLSASVGDRVTITCRASQSISSYLNWYQQKPGKAP KLLIYAASSLQSGVPSRFSGSGSGTEFTLTISSLQPEDFATYYCLQH NSYPLTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGQPREPQVYTLPPSREEMTKNQVSLTCL VKGFYPSDIAVEWESNGQPENNYKTTPPVLDSDGSFFLYSKLTVDKS RWQQGNVFSCSVMHEALHNHYTQKSLSLSPGGGGSGGGGSGGGGSGG GGSGGGGSGGGGSDKTHTCPPCPAPELLGGPSVFLFPPKPKDTLMIS RTPEVTCVVVDVSHEDPEVKFNWYVDGVEVHNAKTKPCEEQYGSTYR CVSVLTVLHQDWLNGKEYKCKVSNKALPAPIEKTISKAKGQPREPQV YTLPPSREEMTKNQVSLTCLVKGFYPSDIAVEWESNGQPENNYKTTP PVLDSDGSFFLYSKLTVDKSRWQQGNVFSCSVMHEALHNHYTQKSLS LSPGK |
| 584. | CD70_1_CCx CD3-scFc | VH CDR1 | SYAMS |
| 585. | CD70_1_CCx CD3-scFc | VH CDR2 | VISGSGGRPNYAESVKG |
| 586. | CD70_1_CCx CD3-scFc | VH CDR3 | VDYSNYLFFDY |
| 587. | CD70_1_CCx CD3-scFc | VL CDR1 | RAGQSVRSSYLG |
| 588. | CD70_1_CCx CD3-scFc | VL CDR2 | GASSRAT |
| 589. | CD70_1_CCx CD3-scFc | VL CDR3 | QQYGYSPPT |
| 590. | CD70_1_CCx CD3-scFc | VH | EVQLLESGGGLVQPGGSLRLSCAASGFTFSSYAMSWVRQAPGKCLEW VSVISGSGGRPNYAESVKGRFTISRDNSKNTLYLQMNSLRDEDTAVY YCAKVDYSNYLFFDYWGQGTLVTVSS |
| 591. | CD70_1_CCx CD3-scFc | VL | EIVLTQSPGTLSLSPGEGATLSCRAGQSVRSSYLGWYQQKPGQAPRL LIYGASSRATGIPDRFSGSGSGTDFTLTISRLEPEDFAVYYCQQYGY SPPTFGCGTKLEIK |
| 592. | CD70_1_CCx CD3-scFc | scFv | EVQLLESGGGLVQPGGSLRLSCAASGFTFSSYAMSWVRQAPGKCLEW VSVISGSGGRPNYAESVKGRFTISRDNSKNTLYLQMNSLRDEDTAVY YCAKVDYSNYLFFDYWGQGTLVTVSSGGGGSGGGGSGGGGSEIVLTQ SPGTLSLSPGEGATLSCRAGQSVRSSYLGWYQQKPGQAPRLLIYGAS SRATGIPDRFSGSGSGTDFTLTISRLEPEDFAVYYCQQYGYSPPTFG CGTKLEIK |
| 593. | CD70_1_CCx CD3-scFc | bispecific molecule | EVQLLESGGGLVQPGGSLRLSCAASGFTFSSYAMSWVRQAPGKCLEW VSVISGSGGRPNYAESVKGRFTISRDNSKNTLYLQMNSLRDEDTAVY YCAKVDYSNYLFFDYWGQGTLVTVSSGGGGSGGGGSGGGGSEIVLTQ SPGTLSLSPGEGATLSCRAGQSVRSSYLGWYQQKPGQAPRLLIYGAS SRATGIPDRFSGSGSGTDFTLTISRLEPEDFAVYYCQQYGYSPPTFG |

TABLE 35-continued

| Sequence table | | | |
|---|---|---|---|
| SEQ ID NO: | Designation | Format/ Source | Sequence |
| | | | CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 594. | CD70_1_CCx CD3-scFc | bispecific HLE molecule | EVQLLESGGGLVQPGGSLRLSCAASGFTFSSYAMSWVRQAPGKCLEW VSVISGSGGRPNYAESVKGRFTISRDNSKNTLYLQMNSLRDEDTAVY YCAKVDYSNYLFFDYWGQGTLVTVSSGGGGSGGGGSGGGGSEIVLTQ SPGTLSLSPGEGATLSCRAGQSVRSSYLGWYQQKPGQAPRLLIYGAS SRATGIPDRFSGSGSGTDFTLTISRLEPEDFAVYYCQQYGYSPPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 595. | CD70_1xCD3 -scFc | VH | EVQLLESGGGLVQPGGSLRLSCAASGFTFSSYAMSWVRQAPGKGLEW VSVISGSGGRPNYAESVKGRFTISRDNSKNTLYLQMNSLRDEDTAVY YCAKVDYSNYLFFDYWGQGTLVTVSS |
| 596. | CD70_1xCD3 -scFc | VL | EIVLTQSPGTLSLSPGEGATLSCRAGQSVRSSYLGWYQQKPGQAPRL LIYGASSRATGIPDRFSGSGSGTDFTLTISRLEPEDFAVYYCQQYGY SPPTFGGGTKLEIK |
| 597. | CD70_1xCD3 -scFc | scFv | EVQLLESGGGLVQPGGSLRLSCAASGFTFSSYAMSWVRQAPGKGLEW VSVISGSGGRPNYAESVKGRFTISRDNSKNTLYLQMNSLRDEDTAVY YCAKVDYSNYLFFDYWGQGTLVTVSSGGGGSGGGGSGGGGSEIVLTQ SPGTLSLSPGEGATLSCRAGQSVRSSYLGWYQQKPGQAPRLLIYGAS SRATGIPDRFSGSGSGTDFTLTISRLEPEDFAVYYCQQYGYSPPTFG GGTKLEIK |
| 598. | CD70_1xCD3 -scFc | bispecific molecule | EVQLLESGGGLVQPGGSLRLSCAASGFTFSSYAMSWVRQAPGKGLEW VSVISGSGGRPNYAESVKGRFTISRDNSKNTLYLQMNSLRDEDTAVY YCAKVDYSNYLFFDYWGQGTLVTVSSGGGGSGGGGSGGGGSEIVLTQ SPGTLSLSPGEGATLSCRAGQSVRSSYLGWYQQKPGQAPRLLIYGAS SRATGIPDRFSGSGSGTDFTLTISRLEPEDFAVYYCQQYGYSPPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 599. | CD70_1xCD3 -scFc | bispecific HLE molecule | EVQLLESGGGLVQPGGSLRLSCAASGFTFSSYAMSWVRQAPGKGLEW VSVISGSGGRPNYAESVKGRFTISRDNSKNTLYLQMNSLRDEDTAVY YCAKVDYSNYLFFDYWGQGTLVTVSSGGGGSGGGGSGGGGSEIVLTQ SPGTLSLSPGEGATLSCRAGQSVRSSYLGWYQQKPGQAPRLLIYGAS SRATGIPDRFSGSGSGTDFTLTISRLEPEDFAVYYCQQYGYSPPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS |

TABLE 35-continued

Sequence table

| SEQ ID NO: | Designation | Format/ Source | Sequence |
|---|---|---|---|
| | | | REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 600. | CD70_2_CCx CD3-scFc | VH CDR1 | IYAMS |
| 601. | CD70_2_CCx CD3-scFc | VH CDR2 | AISGSGGSTFYAESVKG |
| 602. | CD70_2_CCx CD3-scFc | VH CDR3 | HDYSNYPYFDY |
| 603. | CD70_2_CCx CD3-scFc | VL CDR1 | RASQSVRSSYLA |
| 604. | CD70_2_CCx CD3-scFc | VL CDR2 | GASSRAT |
| 605. | CD70_2_CCx CD3-scFc | VL CDR3 | QQYGDLPFT |
| 606. | CD70_2_CCx CD3-scFc | VH | EVQLLESGGGLVQPGGSLKLSCAASGFTFSIYAMSWVRQAPGKCLEW VSAISGSGGSTFYAESVKGRFTISRDNSKNTLYLQMNSLRAEDTAVY YCAKHDYSNYPYFDYWGQGTLVTVSS |
| 607. | CD70_2_CCx CD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGCGTKLEIK |
| 608. | CD70_2_CCx CD3-scFc | scFv | EVQLLESGGGLVQPGGSLKLSCAASGFTFSIYAMSWVRQAPGKCLEW VSAISGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKLEIK |
| 609. | CD70_2_CCx CD3-scFc | bispecific molecule | EVQLLESGGGLVQPGGSLKLSCAASGFTFSIYAMSWVRQAPGKCLEW VSAISGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 610. | CD70_2_CCx CD3-scFc | bispecific HLE molecule | EVQLLESGGGLVQPGGSLKLSCAASGFTFSIYAMSWVRQAPGKCLEW VSAISGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 611. | CD70_2xCD3 -scFc | VH | EVQLLESGGGLVQPGGSLKLSCAASGFTFSIYAMSWVRQAPGKGLEW VSAISGSGGSTFYAESVKGRFTISRDNSKNTLYLQMNSLRAEDTAVY YCAKHDYSNYPYFDYWGQGTLVTVSS |

TABLE 35-continued

| SEQ ID NO: | Designation | Format/ Source | Sequence |
|---|---|---|---|
| Sequence table | | | |
| 612. | CD70_2xCD3 -scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGPGTKLEIK |
| 613. | CD70_2xCD3 -scFc | scFv | EVQLLESGGGLVQPGGSLKLSCAASGFTFSIYAMSWVRQAPGKGLEW VSAISGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKLEIK |
| 614. | CD70_2xCD3 -scFc | bispecific molecule | EVQLLESGGGLVQPGGSLKLSCAASGFTFSIYAMSWVRQAPGKGLEW VSAISGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 615. | CD70_2xCD3 -scFc | bispecific HLE molecule | EVQLLESGGGLVQPGGSLKLSCAASGFTFSIYAMSWVRQAPGKGLEW VSAISGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 616. | CD70_3_CCx CD3-scFc | VH CDR1 | SYAMS |
| 617. | CD70_3_CCx CD3-scFc | VH CDR2 | AISGSGGRTFYAESVEG |
| 618. | CD70_3_CCx CD3-scFc | VH CDR3 | HDYSNYPYFDY |
| 619. | CD70_3_CCx CD3-scFc | VL CDR1 | RASQSVRSSYLA |
| 620. | CD70_3_CCx CD3-scFc | VL CDR2 | GASSRAT |
| 621. | CD70_3_CCx CD3-scFc | VL CDR3 | QQYGSSPFT |
| 622. | CD70_3_CCx CD3-scFc | VH | EVQLLESGGGMVQPGGSLRLSCAASGFTFSSYAMSWVRQAPGKCLEW VSAISGSGGRTFYAESVEGRFTISRDNSKNTLFLQMNSLRAEDTAVY YCAKHDYSNYPYFDYWGQGTLVTVSS |
| 623. | CD70_3_CCx CD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGS SPFTFGCGTKLEIK |
| 624. | CD70_3_CCx CD3-scFc | scFv | EVQLLESGGGMVQPGGSLRLSCAASGFTFSSYAMSWVRQAPGKCLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ |

TABLE 35-continued

Sequence table

| SEQ ID NO: | Designation | Format/ Source | Sequence |
|---|---|---|---|
| | | | SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIK |
| 625. | CD70_3_CCx CD3-scFc | bispecific molecule | EVQLLESGGGMVQPGGSLRLSCAASGFTFSSYAMSWVRQAPGKCLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 626. | CD70_3_CCx CD3-scFc | bispecific HLE molecule | EVQLLESGGGMVQPGGSLRLSCAASGFTFSSYAMSWVRQAPGKCLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 627. | CD70_3xCD3 -scFc | VH | EVQLLESGGGMVQPGGSLRLSCAASGFTFSSYAMSWVRQAPGKGLEW VSAISGSGGRTFYAESVEGRFTISRDNSKNTLFLQMNSLRAEDTAVY YCAKHDYSNYPYFDYWGQGTLVTVSS |
| 628. | CD70_3xCD3 -scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGS SPFTFGPGTKLEIK |
| 629. | CD70_3xCD3 -scFc | scFv | EVQLLESGGGMVQPGGSLRLSCAASGFTFSSYAMSWVRQAPGKGLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIK |
| 630. | CD70_3xCD3 -scFc | bispecific molecule | EVQLLESGGGMVQPGGSLRLSCAASGFTFSSYAMSWVRQAPGKGLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 631. | CD70_3xCD3 -scFc | bispecific HLE molecule | EVQLLESGGGMVQPGGSLRLSCAASGFTFSSYAMSWVRQAPGKGLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ |

TABLE 35-continued

Sequence table

| SEQ ID NO: | Designation | Format/ Source | Sequence |
|---|---|---|---|
| | | | PEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 632. | CD70_4_CCx CD3-scFc | VH CDR1 | SYAMS |
| 633. | CD70_4_CCx CD3-scFc | VH CDR2 | AISGSGGRTFYAESVEG |
| 634. | CD70_4_CCx CD3-scFc | VH CDR3 | HDYSNYPYFDY |
| 635. | CD70_4_CCx CD3-scFc | VL CDR1 | RASQSIRSSYLA |
| 636. | CD70_4_CCx CD3-scFc | VL CDR2 | GASSRAT |
| 637. | CD70_4_CCx CD3-scFc | VL CDR3 | QQYGDLPFT |
| 638. | CD70_4_CCx CD3-scFc | VH | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSS |
| 639. | CD70_4_CCx CD3-scFc | VL | EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK |
| 640. | CD70_4_CCx CD3-scFc | scFv | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK |
| 641. | CD70_4_CCx CD3-scFc | bispecific molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 642. | CD70_4_CCx CD3-scFc | bispecific HLE molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLT |

TABLE 35-continued

Sequence table

| SEQ ID NO: | Designation | Format/ Source | Sequence |
|---|---|---|---|
| | | | VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 643. | CD70_4xCD3 -scFc | VH | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 644. | CD70_4xCD3 -scFc | VL | EIVLTQSPGTLSLSPGERATLSCRASQSIRSSYLAWYQQKPGQAPRL LIYGASSRATGIPDRFSGSGSGTDFTLTISRLEPEDFAVYYCQQYGD LPFTFGPGTKLEIK |
| 645. | CD70_4xCD3 -scFc | scFv | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSSYLAWYQQKPGQAPRLLIYGAS SRATGIPDRFSGSGSGTDFTLTISRLEPEDFAVYYCQQYGDLPFTFG PGTKLEIK |
| 646. | CD70_4xCD3 -scFc | bispecific molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSSYLAWYQQKPGQAPRLLIYGAS SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 647. | CD70_4xCD3 -scFc | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSSYLAWYQQKPGQAPRLLIYGAS SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 648. | CD70_5_CCx CD3-scFc | VH CDR1 | SYAMS |
| 649. | CD70_5_CCx CD3-scFc | VH CDR2 | AISGSGGRTHYAESVKG |
| 650. | CD70_5_CCx CD3-scFc | VH CDR3 | HDYSNYPYFDY |
| 651. | CD70_5_CCx CD3-scFc | VL CDR1 | RASQSVRSSYLA |
| 652. | CD70_5_CCx CD3-scFc | VL CDR2 | GASSRAT |
| 653. | CD70_5_CCx CD3-scFc | VL CDR3 | QQYGSSPFT |
| 654. | CD70_5_CCx CD3-scFc | VH | EVQLLESGGGLVQSGGSLRLSCAASGFTFSSYAMSWVRQAPGKCLEW VSAISGSGGRTHYAESVKGRFTISRDNSKNTLYLQMNSLRAEDTAVY YCAKHDYSNYPYFDYWGQGTLVTVSS |

TABLE 35-continued

Sequence table

| SEQ ID NO: | Designation | Format/ Source | Sequence |
|---|---|---|---|
| 655. | CD70_5_CCx CD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGS SPFTFGCGTKLEIK |
| 656. | CD70_5_CCx CD3-scFc | scFv | EVQLLESGGGLVQSGGSLRLSCAASGFTFSSYAMSWVRQAPGKCLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIK |
| 657. | CD70_5_CCx CD3-scFc | bispecific molecule | EVQLLESGGGLVQSGGSLRLSCAASGFTFSSYAMSWVRQAPGKCLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 658. | CD70_5_CCx CD3-scFc | bispecific HLE molecule | EVQLLESGGGLVQSGGSLRLSCAASGFTFSSYAMSWVRQAPGKCLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 659. | CD70_5xCD3 -scFc | VH | EVQLLESGGGLVQSGGSLRLSCAASGFTFSSYAMSWVRQAPGKGLEW VSAISGSGGRTHYAESVKGRFTISRDNSKNTLYLQMNSLRAEDTAVY YCAKHDYSNYPYFDYWGQGTLVTVSS |
| 660. | CD70_5xCD3 -scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGS SPFTFGPGTKLEIK |
| 661. | CD70_5xCD3 -scFc | scFv | EVQLLESGGGLVQSGGSLRLSCAASGFTFSSYAMSWVRQAPGKGLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIK |
| 662. | CD70_5xCD3 -scFc | bispecific molecule | EVQLLESGGGLVQSGGSLRLSCAASGFTFSSYAMSWVRQAPGKGLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 35-continued

Sequence table

| SEQ ID NO: | Designation | Format/ Source | Sequence |
|---|---|---|---|
| 663. | CD70_5xCD3 -scFc | bispecific HLE molecule | EVQLLESGGGLVQSGGSLRLSCAASGFTFSSYAMSWVRQAPGKGLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 664. | CD70_6_CCx CD3-scFc | VH CDR1 | SYAMS |
| 665. | CD70_6_CCx CD3-scFc | VH CDR2 | LISGSGGRTHYAESVKG |
| 666. | CD70_6_CCx CD3-scFc | VH CDR3 | HDYSNYPYFDY |
| 667. | CD70_6_CCx CD3-scFc | VL CDR1 | RASQSVRSTYLA |
| 668. | CD70_6_CCx CD3-scFc | VL CDR2 | DASSRAT |
| 669. | CD70_6_CCx CD3-scFc | VL CDR3 | QQYGSSPPT |
| 670. | CD70_6_CCx CD3-scFc | VH | EVQLLESGGGLVQPGGSLRLSCAASGFTFSSYAMSWVRQAPGKCLEW VSLISGSGGRTHYAESVKGRFTISRDNSKNTLYLQMNSLRAEDTAVY YCAKHDYSNYPYFDYWGQGTLVTVSS |
| 671. | CD70_6_CCx CD3-scFc | VL | EIVLTQSPGTLSLSPGERATLSCRASQSVRSTYLAWYQQKPGQAPRL LIYDASSRATGIPDRFSGSGSGTDFTLTISRLEPEDFAVYFCQQYGS SPPTFGCGTKLEIK |
| 672. | CD70_6_CCx CD3-scFc | scFv | EVQLLESGGGLVQPGGSLRLSCAASGFTFSSYAMSWVRQAPGKCLEW VSLISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYDAS SRATGIPDRFSGSGSGTDFTLTISRLEPEDFAVYFCQQYGSSPPTFG CGTKLEIK |
| 673. | CD70_6_CCx CD3-scFc | bispecific molecule | EVQLLESGGGLVQPGGSLRLSCAASGFTFSSYAMSWVRQAPGKCLEW VSLISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYDAS SRATGIPDRFSGSGSGTDFTLTISRLEPEDFAVYFCQQYGSSPPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 674. | CD70_6_CCx CD3-scFc | bispecific HLE molecule | EVQLLESGGGLVQPGGSLRLSCAASGFTFSSYAMSWVRQAPGKCLEW VSLISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYDAS SRATGIPDRFSGSGSGTDFTLTISRLEPEDFAVYFCQQYGSSPPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT |

TABLE 35-continued

| SEQ ID NO: | Designation | Format/ Source | Sequence |
|---|---|---|---|
| Sequence table | | | |
| | | | AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 675. | CD70_6xCD3 -scFc | VH | EVQLLESGGGLVQPGGSLRLSCAASGFTFSSYAMSWVRQAPGKGLEW<br>VSLISGSGGRTHYAESVKGRFTISRDNSKNTLYLQMNSLRAEDTAVY<br>YCAKHDYSNYPYFDYWGQGTLVTVSS |
| 676. | CD70_6xCD3 -scFc | VL | EIVLTQSPGTLSLSPGERATLSCRASQSVRSTYLAWYQQKPGQAPRL<br>LIYDASSRATGIPDRFSGSGSGTDFTLTISRLEPEDFAVYFCQQYGS<br>SPPTFGGGTKLEIK |
| 677. | CD70_6xCD3 -scFc | scFv | EVQLLESGGGLVQPGGSLRLSCAASGFTFSSYAMSWVRQAPGKGLEW<br>VSLISGSGGRTHYAESVKGRFTISRDNSKNTLYLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSTYLAWYQQKPGQAPRLLIYDAS<br>SRATGIPDRFSGSGSGTDFTLTISRLEPEDFAVYFCQQYGSSPPTFG<br>GGTKLEIK |
| 678. | CD70_6xCD3 -scFc | bispecific molecule | EVQLLESGGGLVQPGGSLRLSCAASGFTFSSYAMSWVRQAPGKGLEW<br>VSLISGSGGRTHYAESVKGRFTISRDNSKNTLYLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSTYLAWYQQKPGQAPRLLIYDAS<br>SRATGIPDRFSGSGSGTDFTLTISRLEPEDFAVYFCQQYGSSPPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 679. | CD70_6xCD3 -scFc | bispecific HLE molecule | EVQLLESGGGLVQPGGSLRLSCAASGFTFSSYAMSWVRQAPGKGLEW<br>VSLISGSGGRTHYAESVKGRFTISRDNSKNTLYLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSTYLAWYQQKPGQAPRLLIYDAS<br>SRATGIPDRFSGSGSGTDFTLTISRLEPEDFAVYFCQQYGSSPPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 680. | CD70_7_CCx CD3-scFc | VH CDR1 | TYAMS |
| 681. | CD70_7_CCx CD3-scFc | VH CDR2 | AISGSGGSTFYAESVKG |
| 682. | CD70_7_CCx CD3-scFc | VH CDR3 | HDYSNYPYFDY |
| 683. | CD70_7_CCx CD3-scFc | VL CDR1 | RASQSVRSSYLA |

TABLE 35-continued

Sequence table

| SEQ ID NO: | Designation | Format/ Source | Sequence |
|---|---|---|---|
| 684. | CD70_7_CCx CD3-scFc | VL CDR2 | GASSRAT |
| 685. | CD70_7_CCx CD3-scFc | VL CDR3 | QQYGDLPFT |
| 686. | CD70_7_CCx CD3-scFc | VH | EVQLLESGGGLVQPGGSLRLSCAASGFTFSTYAMSWVRQAPGKCLEW VSAISGSGGSTFYAESVKGRFTISRDNSKNTLSLQMNSLRAEDTAVY YCAKHDYSNYPYFDYWGQGTLVTVSS |
| 687. | CD70_7_CCx CD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGCGTKLEIK |
| 688. | CD70_7_CCx CD3-scFc | scFv | EVQLLESGGGLVQPGGSLRLSCAASGFTFSTYAMSWVRQAPGKCLEW VSAISGSGGSTFYAESVKGRFTISRDNSKNTLSLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKLEIK |
| 689. | CD70_7_CCx CD3-scFc | bispecific molecule | EVQLLESGGGLVQPGGSLRLSCAASGFTFSTYAMSWVRQAPGKCLEW VSAISGSGGSTFYAESVKGRFTISRDNSKNTLSLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 690. | CD70_7_CCx CD3-scFc | bispecific HLE molecule | EVQLLESGGGLVQPGGSLRLSCAASGFTFSTYAMSWVRQAPGKCLEW VSAISGSGGSTFYAESVKGRFTISRDNSKNTLSLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 691. | CD70_7xCD3 -scFc | VH | EVQLLESGGGLVQPGGSLRLSCAASGFTFSTYAMSWVRQAPGKGLEW VSAISGSGGSTFYAESVKGRFTISRDNSKNTLSLQMNSLRAEDTAVY YCAKHDYSNYPYFDYWGQGTLVTVSS |
| 692. | CD70_7xCD3 -scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGPGTKLEIK |
| 693. | CD70_7xCD3 -scFc | scFv | EVQLLESGGGLVQPGGSLRLSCAASGFTFSTYAMSWVRQAPGKGLEW VSAISGSGGSTFYAESVKGRFTISRDNSKNTLSLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKLEIK |
| 694. | CD70_7xCD3 -scFc | bispecific molecule | EVQLLESGGGLVQPGGSLRLSCAASGFTFSTYAMSWVRQAPGKGLEW VSAISGSGGSTFYAESVKGRFTISRDNSKNTLSLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS |

TABLE 35-continued

Sequence table

| SEQ ID NO: | Designation | Format/ Source | Sequence |
|---|---|---|---|
| | | | SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 695. | CD70_7xCD3 -scFc | bispecific HLE molecule | EVQLLESGGGLVQPGGSLRLSCAASGFTFSTYAMSWVRQAPGKGLEW VSAISGSGGSTFYAESVKGRFTISRDNSKNTLSLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 696. | CD70_8_CCx CD3-scFc | VH CDR1 | TYAMS |
| 697. | CD70_8_CCx CD3-scFc | VH CDR2 | AISGSGGRTFYAESVEG |
| 698. | CD70_8_CCx CD3-scFc | VH CDR3 | HDYSNYPYFDY |
| 699. | CD70_8_CCx CD3-scFc | VL CDR1 | RASQSVRSTYLA |
| 700. | CD70_8_CCx CD3-scFc | VL CDR2 | GASSRAT |
| 701. | CD70_8_CCx CD3-scFc | VL CDR3 | QQYGDLPFT |
| 702. | CD70_8_CCx CD3-scFc | VH | EVQLLESGGGMVQPGGSLRLSCAASGFTFSTYAMSWVRQAPGKCLEW VSAISGSGGRTFYAESVEGRFTISRDNSKNTLYLQMNSLRAEDTAVY YCAKHDYSNYPYFDYWGQGTLVTVSS |
| 703. | CD70_8_CCx CD3-scFc | VL | EIVLTQSPGTLSLSPGERATLSCRASQSVRSTYLAWYQQKPGQAPRL LIYGASSRATGIPDRFSGSGSGTDFTLTISRLEPEDFAVYSCQQYGD LPFTFGCGTKLEIK |
| 704. | CD70_8_CCx CD3-scFc | scFv | EVQLLESGGGMVQPGGSLRLSCAASGFTFSTYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG CGTKLEIK |
| 705. | CD70_8_CCx CD3-scFc | bispecific molecule | EVQLLESGGGMVQPGGSLRLSCAASGFTFSTYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 35-continued

| Sequence table | | | |
|---|---|---|---|
| SEQ ID NO: | Designation | Format/ Source | Sequence |
| 706. | CD70_8_CCx CD3-scFc | bispecific HLE molecule | EVQLLESGGGMVQPGGSLRLSCAASGFTFSTYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 707. | CD70_8xCD3 -scFc | VH | EVQLLESGGGMVQPGGSLRLSCAASGFTFSTYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 708. | CD70_8xCD3 -scFc | VL | EIVLTQSPGTLSLSPGERATLSCRASQSVRSTYLAWYQQKPGQAPRL LIYGASSRATGIPDRFSGSGSGTDFTLTISRLEPEDFAVYSCQQYGD LPFTFGPGTKLEIK |
| 709. | CD70_8xCD3 -scFc | scFv | EVQLLESGGGMVQPGGSLRLSCAASGFTFSTYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG PGTKLEIK |
| 710. | CD70_8xCD3 -scFc | bispecific molecule | EVQLLESGGGMVQPGGSLRLSCAASGFTFSTYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 711. | CD70_8xCD3 -scFc | bispecific HLE molecule | EVQLLESGGGMVQPGGSLRLSCAASGFTFSTYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 712. | CD70_9_CCx CD3-scFc | VH CDR1 | SYAMS |

TABLE 35-continued

Sequence table

| SEQ ID NO: | Designation | Format/ Source | Sequence |
|---|---|---|---|
| 713. | CD70_9_CCx CD3-scFc | VH CDR2 | AISGSGGYTYYAESVKG |
| 714. | CD70_9_CCx CD3-scFc | VH CDR3 | HDYSNYPYFDY |
| 715. | CD70_9_CCx CD3-scFc | VL CDR1 | RASQSVRSNYLA |
| 716. | CD70_9_CCx CD3-scFc | VL CDR2 | GASSRAT |
| 717. | CD70_9_CCx CD3-scFc | VL CDR3 | QQYGDLPFT |
| 718. | CD70_9_CCx CD3-scFc | VH | EVQLLESGGGLVQPGGSLRLSCAASGFTFSSYAMSWVRQAPGKCLEW VSAISGSGGYTYYAESVKGRFTISRDNSKNTLYLQMNSLRAEDTAVY YCAKHDYSNYPYFDYWGQGTLVTVSS |
| 719. | CD70_9_CCx CD3-scFc | VL | EIVLTQSPGTLSLSPGERATLSCRASQSVRSNYLAWYQQKPGQAPRL LIYGASSRATGIPDRFSGSGSGTDFTLTISRLEPEDFAVYYCQQYGD LPFTFGCGTKVEIK |
| 720. | CD70_9_CCx CD3-scFc | scFv | EVQLLESGGGLVQPGGSLRLSCAASGFTFSSYAMSWVRQAPGKCLEW VSAISGSGGYTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIK |
| 721. | CD70_9_CCx CD3-scFc | bispecific molecule | EVQLLESGGGLVQPGGSLRLSCAASGFTFSSYAMSWVRQAPGKCLEW VSAISGSGGYTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 722. | CD70_9_CCx CD3-scFc | bispecific HLE molecule | EVQLLESGGGLVQPGGSLRLSCAASGFTFSSYAMSWVRQAPGKCLEW VSAISGSGGYTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 723. | CD70_9xCD3 -scFc | VH | EVQLLESGGGLVQPGGSLRLSCAASGFTFSSYAMSWVRQAPGKGLEW VSAISGSGGYTYYAESVKGRFTISRDNSKNTLYLQMNSLRAEDTAVY YCAKHDYSNYPYFDYWGQGTLVTVSS |
| 724. | CD70_9xCD3 -scFc | VL | EIVLTQSPGTLSLSPGERATLSCRASQSVRSNYLAWYQQKPGQAPRL LIYGASSRATGIPDRFSGSGSGTDFTLTISRLEPEDFAVYYCQQYGD LPFTFGPGTKVEIK |

TABLE 35-continued

| Sequence table | | | |
|---|---|---|---|
| SEQ ID NO: | Designation | Format/ Source | Sequence |
| 725. | CD70_9xCD3 -scFc | scFv | EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK |
| 726. | CD70_9xCD3 -scFc | bispecific molecule | EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 727. | CD70_9xCD3 -scFc | bispecific HLE molecule | EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 728. | CD70_10_CC xCD3-scFc | VH CDR1 | SYAMS |
| 729. | CD70_10_CC xCD3-scFc | VH CDR2 | AISGSGGSTFYAESVKG |
| 730. | CD70_10_CC xCD3-scFc | VH CDR3 | HDYSNYPYFDY |
| 731. | CD70_10_CC xCD3-scFc | VL CDR1 | RASQSVRSSYLA |
| 732. | CD70_10_CC xCD3-scFc | VL CDR2 | GASSRAT |
| 733. | CD70_10_CC xCD3-scFc | VL CDR3 | QQYGDLPFT |
| 734. | CD70_10_CC xCD3-scFc | VH | EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSS |
| 735. | CD70_10_CC xCD3-scFc | VL | EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK |
| 736. | CD70_10_CC xCD3-scFc | scFv | EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK |

TABLE 35-continued

Sequence table

| SEQ ID NO: | Designation | Format/ Source | Sequence |
|---|---|---|---|
| 737. | CD70_10_CC xCD3-scFc | bispecific molecule | EVQLLESGGGLAQPGGSLRLSCAASGFTFSSYAMSWVRQAPGKCLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 738. | CD70_10_CC xCD3-scFc | bispecific HLE molecule | EVQLLESGGGLAQPGGSLRLSCAASGFTFSSYAMSWVRQAPGKCLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 739. | CD70_10xCD 3-scFc | VH | EVQLLESGGGLAQPGGSLRLSCAASGFTFSSYAMSWVRQAPGKGLEW VSAISGSGGSTFYAESVKGRFTISRDNSKNTLYLQMNSLRAEDTAVY FCAKHDYSNYPYFDYWGQGTLVTVSS |
| 740. | CD70_10xCD 3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGPGTKVEIK |
| 741. | CD70_10xCD 3-scFc | scFv | EVQLLESGGGLAQPGGSLRLSCAASGFTFSSYAMSWVRQAPGKGLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIK |
| 742. | CD70_10xCD 3-scFc | bispecific molecule | EVQLLESGGGLAQPGGSLRLSCAASGFTFSSYAMSWVRQAPGKGLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 743. | CD70_10xCD 3-scFc | bispecific HLE molecule | EVQLLESGGGLAQPGGSLRLSCAASGFTFSSYAMSWVRQAPGKGLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD |

TABLE 35-continued

| Sequence table | | | |
|---|---|---|---|
| SEQ ID NO: | Designation | Format/ Source | Sequence |
| | | | IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 744. | CD70_11_CC xCD3-scFc | VH CDR1 | SYAMS |
| 745. | CD70_11_CC xCD3-scFc | VH CDR2 | AISGSGGRTFYAESVEG |
| 746. | CD70_11_CC xCD3-scFc | VH CDR3 | HDYSNYPYFDY |
| 747. | CD70_11_CC xCD3-scFc | VL CDR1 | RASQSVRSNYLA |
| 748. | CD70_11_CC xCD3-scFc | VL CDR2 | GASSRAT |
| 749. | CD70_11_CC xCD3-scFc | VL CDR3 | QQYGDLPFT |
| 750. | CD70_11_CC xCD3-scFc | VH | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSS |
| 751. | CD70_11_CC xCD3-scFc | VL | EIVLTQSPGTLSLSPGERATLSCRASQSVRSNYLAWYQQKPGQAPRL LIYGASSRATGIPDRFSGSGSGTDFTLTISRLEPEDFAVYYCQQYGD LPFTFGCGTKVEIK |
| 752. | CD70_11_CC xCD3-scFc | scFv | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIK |
| 753. | CD70_11_CC xCD3-scFc | bispecific molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 754. | CD70_11_CC xCD3-scFc | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 755. | CD70_11xCD 3-scFc | VH | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 756. | CD70_11xCD 3-scFc | VL | EIVLTQSPGTLSLSPGERATLSCRASQSVRSNYLAWYQQKPGQAPRL LIYGASSRATGIPDRFSGSGSGTDFTLTISRLEPEDFAVYYCQQYGD LPFTFGPGTKVEIK |
| 757. | CD70_11xCD 3-scFc | scFv | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG PGTKVEIK |
| 758. | CD70_11xCD 3-scFc | bispecific molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 759. | CD70_11xCD 3-scFc | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 760. | CD70_12_CC xCD3-scFc | VH CDR1 | SYAMS |
| 761. | CD70_12_CC xCD3-scFc | VH CDR2 | AISGSGGRTFYAESVEG |
| 762. | CD70_12_CC xCD3-scFc | VH CDR3 | HDYSNYPYFDY |
| 763. | CD70_12_CC xCD3-scFc | VL CDR1 | RASQSVRSSYLA |
| 764. | CD70_12_CC xCD3-scFc | VL CDR2 | GASSRAT |
| 765. | CD70_12_CC xCD3-scFc | VL CDR3 | QQYGSSPFT |
| 766. | CD70_12_CC xCD3-scFc | VH | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSS |
| 767. | CD70_12_CC xCD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGS SPFTFGCGTKVEIK |

TABLE 35-continued

| SEQ ID NO: | Designation | Format/ Source | Sequence |
|---|---|---|---|
| Sequence table | | | |
| 768. | CD70_12_CC xCD3-scFc | scFv | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKVEIK |
| 769. | CD70_12_CC xCD3-scFc | bispecific molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 770. | CD70_12_CC xCD3-scFc | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 771. | CD70_12xCD 3-scFc | VH | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 772. | CD70_12xCD 3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGS SPFTFGPGTKVEIK |
| 773. | CD70_12xCD 3-scFc | scFv | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKVEIK |
| 774. | CD70_12xCD 3-scFc | bispecific molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 775. | CD70_12xCD 3-scFc | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT |

TABLE 35-continued

Sequence table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 776. | CD70_13_CC xCD3-scFc | VH CDR1 | SYAMS |
| 777. | CD70_13_CC xCD3-scFc | VH CDR2 | AISGSGGSTFYAESVQG |
| 778. | CD70_13_CC xCD3-scFc | VH CDR3 | HDYSNYPYFDY |
| 779. | CD70_13_CC xCD3-scFc | VL CDR1 | RASQSVRGNYLA |
| 780. | CD70_13_CC xCD3-scFc | VL CDR2 | GASSRAT |
| 781. | CD70_13_CC xCD3-scFc | VL CDR3 | QQYGYSPFT |
| 782. | CD70_13_CC xCD3-scFc | VH | EVQLLESGGGLVQPGGSLRLSCAASGFTFSSYAMSWVRQAPGKCLEW VSAISGSGGSTFYAESVQGRFTISRDNSKNTLYLQVNSLRAEDTAVY YCARHDYSNYPYFDYWGQGTLVTVSS |
| 783. | CD70_13_CC xCD3-scFc | VL | EIVLTQSPGTLSLSPGERATLSCRASQSVRGNYLAWYQQKPGQAPRL LIYGASSRATGIPDRFSGSGSGTDFTLTISRLEPEDFAVYYCQQYGY SPFTFGCGTKVEIK |
| 784. | CD70_13_CC xCD3-scFc | scFv | EVQLLESGGGLVQPGGSLRLSCAASGFTFSSYAMSWVRQAPGKCLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG CGTKVEIK |
| 785. | CD70_13_CC xCD3-scFc | bispecific molecule | EVQLLESGGGLVQPGGSLRLSCAASGFTFSSYAMSWVRQAPGKCLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 786. | CD70_13_CC xCD3-scFc | bispecific HLE molecule | EVQLLESGGGLVQPGGSLRLSCAASGFTFSSYAMSWVRQAPGKCLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF |

TABLE 35-continued

| Sequence table | | | |
|---|---|---|---|
| SEQ ID NO: | Designation | Format/ Source | Sequence |
| | | | SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 787. | CD70_13xCD 3-scFc | VH | EVQLLESGGGLVQPGGSLRLSCAASGFTFSSYAMSWVRQAPGKGLEW VSAISGSGGSTFYAESVQGRFTISRDNSKNTLYLQVNSLRAEDTAVY YCARHDYSNYPYFDYWGQGTLVTVSS |
| 788. | CD70_13xCD 3-scFc | VL | EIVLTQSPGTLSLSPGERATLSCRASQSVRGNYLAWYQQKPGQAPRL LIYGASSRATGIPDRFSGSGSGTDFTLTISRLEPEDFAVYYCQQYGY SPFTFGPGTKVEIK |
| 789. | CD70_13xCD 3-scFc | scFv | EVQLLESGGGLVQPGGSLRLSCAASGFTFSSYAMSWVRQAPGKGLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG PGTKVEIK |
| 790. | CD70_13xCD 3-scFc | bispecific molecule | EVQLLESGGGLVQPGGSLRLSCAASGFTFSSYAMSWVRQAPGKGLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 791. | CD70_13xCD 3-scFc | bispecific HLE molecule | EVQLLESGGGLVQPGGSLRLSCAASGFTFSSYAMSWVRQAPGKGLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 792. | CD70_14_CC xCD3-scFc | VH CDR1 | TYAMS |
| 793. | CD70_14_CC xCD3-scFc | VH CDR2 | AISGSGGGTFYAESVKG |
| 794. | CD70_14_CC xCD3-scFc | VH CDR3 | HDYSNYPYFDY |
| 795. | CD70_14_CC xCD3-scFc | VL CDR1 | RASQSIRSNYLA |
| 796. | CD70_14_CC xCD3-scFc | VL CDR2 | GASSRAT |
| 797. | CD70_14_CC xCD3-scFc | VL CDR3 | QQYGSSPFT |

TABLE 35-continued

| Sequence table | | | |
|---|---|---|---|
| SEQ ID NO: | Designation | Format/ Source | Sequence |
| 798. | CD70_14_CC xCD3-scFc | VH | EVQLLESGGGLVQPGGSLRLSCAASGFTFSTYAMSWVRQAPGKCLEW VSAISGSGGGTFYAESVKGRFTISRDNSKNTLYLQMNSLRAEDTAVY YCAKHDYSNYPYFDYWGQGTLVTVSS |
| 799. | CD70_14_CC xCD3-scFc | VL | EIVLTQSPGTLSLSPGERATLSCRASQSIRSNYLAWYQQKPGQAPRL LIYGASSRATGIPDRFSGSGSGTDFTLTISRLEPEDFAVYYCQQYGS SPFTFGCGTKVEIK |
| 800. | CD70_14_CC xCD3-scFc | scFv | EVQLLESGGGLVQPGGSLRLSCAASGFTFSTYAMSWVRQAPGKCLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG CGTKVEIK |
| 801. | CD70_14_CC xCD3-scFc | bispecific molecule | EVQLLESGGGLVQPGGSLRLSCAASGFTFSTYAMSWVRQAPGKCLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 802. | CD70_14_CC xCD3-scFc | bispecific HLE molecule | EVQLLESGGGLVQPGGSLRLSCAASGFTFSTYAMSWVRQAPGKCLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 803. | CD70_14xCD 3-scFc | VH | EVQLLESGGGLVQPGGSLRLSCAASGFTFSTYAMSWVRQAPGKGLEW VSAISGSGGGTFYAESVKGRFTISRDNSKNTLYLQMNSLRAEDTAVY YCAKHDYSNYPYFDYWGQGTLVTVSS |
| 804. | CD70_14xCD 3-scFc | VL | EIVLTQSPGTLSLSPGERATLSCRASQSIRSNYLAWYQQKPGQAPRL LIYGASSRATGIPDRFSGSGSGTDFTLTISRLEPEDFAVYYCQQYGS SPFTFGPGTKVEIK |
| 805. | CD70_14xCD 3-scFc | scFv | EVQLLESGGGLVQPGGSLRLSCAASGFTFSTYAMSWVRQAPGKGLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG PGTKVEIK |
| 806. | CD70_14xCD 3-scFc | bispecific molecule | EVQLLESGGGLVQPGGSLRLSCAASGFTFSTYAMSWVRQAPGKGLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT |

TABLE 35-continued

| Sequence table | | | |
|---|---|---|---|
| SEQ ID NO: | Designation | Format/ Source | Sequence |
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 807. | CD70_14xCD 3-scFc | bispecific HLE molecule | EVQLLESGGGLVQPGGSLRLSCAASGFTFSTYAMSWVRQAPGKGLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 808. | CD70_15_CC xCD3-scFc | VH CDR1 | TYAMS |
| 809. | CD70_15_CC xCD3-scFc | VH CDR2 | LISGSGGRTYYAESVKG |
| 810. | CD70_15_CC xCD3-scFc | VH CDR3 | HDYSNYPYFDY |
| 811. | CD70_15_CC xCD3-scFc | VL CDR1 | RASQSVRSNYLA |
| 812. | CD70_15_CC xCD3-scFc | VL CDR2 | GASNRAT |
| 813. | CD70_15_CC xCD3-scFc | VL CDR3 | QQYGISPPT |
| 814. | CD70_15_CC xCD3-scFc | VH | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSS |
| 815. | CD70_15_CC xCD3-scFc | VL | EIVLTQSPGTLSLSPGERATLSCRASQSVRSNYLAWYQQKPGQAPRL LIYGASNRATGIPDRFSGSGSGTDFTLTISRLEPEDFAVYSCQQYGI SPPTFGCGTKVEIK |
| 816. | CD70_15_CC xCD3-scFc | scFv | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG CGTKVEIK |
| 817. | CD70_15_CC xCD3-scFc | bispecific molecule | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 35-continued

| Sequence table | | | |
|---|---|---|---|
| SEQ ID NO: | Designation | Format/ Source | Sequence |
| 818. | CD70_15_CC xCD3-scFc | bispecific HLE molecule | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 819. | CD70_15xCD 3-scFc | VH | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSS |
| 820. | CD70_15xCD 3-scFc | VL | EIVLTQSPGTLSLSPGERATLSCRASQSVRSNYLAWYQQKPGQAPRL LIYGASNRATGIPDRFSGSGSGTDFTLTISRLEPEDFAVYSCQQYGI SPPTFGGGTKVEIK |
| 821. | CD70_15xCD 3-scFc | scFv | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG GGTKVEIK |
| 822. | CD70_15xCD 3-scFc | bispecific molecule | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG GGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 823. | CD70_15xCD 3-scFc | bispecific HLE molecule | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG GGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| Sequence table | | | |
| 824. | CD70_16_CC xCD3-scFc | VH CDR1 | SYAMS |
| 825. | CD70_16_CC xCD3-scFc | VH CDR2 | AISGSGGRAQYAESVQG |
| 826. | CD70_16_CC xCD3-scFc | VH CDR3 | HDYSNYPYFDY |
| 827. | CD70_16_CC xCD3-scFc | VL CDR1 | RASQSVSSNLA |
| 828. | CD70_16_CC xCD3-scFc | VL CDR2 | GSSSRAT |
| 829. | CD70_16_CC xCD3-scFc | VL CDR3 | QQYGSSPPP |
| 830. | CD70_16_CC xCD3-scFc | VH | EVQLLESGGGLVQPGGSLRLSCAASGFTFSSYAMSWVRQSPGKCLEW VSAISGSGGRAQYAESVQGRFTVSRDNSKNTLYLQMNSLRAEDTAVY YCAKHDYSNYPYFDYWGQGTLVTVSS |
| 831. | CD70_16_CC xCD3-scFc | VL | EIVLTQSPATLSVSPGERATLSCRASQSVSSNLAWYQQKPGQAPRLL IYGSSSRATGIPDRFSGSGSGTDFTLTISRLEPEDFAVYYCQQYGSS PPPFGCGTKVEIK |
| 832. | CD70_16_CC xCD3-scFc | scFv | EVQLLESGGGLVQPGGSLRLSCAASGFTFSSYAMSWVRQSPGKCLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGC GTKVEIK |
| 833. | CD70_16_CC xCD3-scFc | bispecific molecule | EVQLLESGGGLVQPGGSLRLSCAASGFTFSSYAMSWVRQSPGKCLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGC GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVL |
| 834. | CD70_16_CC xCD3-scFc | bispecific HLE molecule | EVQLLESGGGLVQPGGSLRLSCAASGFTFSSYAMSWVRQSPGKCLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGC GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGKGGGGSGGGGSGGGGSGGGGSGGGG SGGGGSDKTHTCPPCPAPELLGGPSVFLFPPKPKDTLMISRTPEVTC VVVDVSHEDPEVKFNWYVDGVEVHNAKTKPCEEQYGSTYRCVSVLTV LHQDWLNGKEYKCKVSNKALPAPIEKTISKAKGQPREPQVYTLPPSR EEMTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 835. | CD70_16xCD 3-scFc | VH | EVQLLESGGGLVQPGGSLRLSCAASGFTFSSYAMSWVRQSPGKGLEW VSAISGSGGRAQYAESVQGRFTVSRDNSKNTLYLQMNSLRAEDTAVY YCAKHDYSNYPYFDYWGQGTLVTVSS |
| 836. | CD70_16xCD 3-scFc | VL | EIVLTQSPATLSVSPGERATLSCRASQSVSSNLAWYQQKPGQAPRLL IYGSSSRATGIPDRFSGSGSGTDFTLTISRLEPEDFAVYYCQQYGSS PPPFGGGTKVEIK |

TABLE 35-continued

| SEQ ID NO: | Designation | Format/ Source | Sequence |
|---|---|---|---|
| Sequence table | | | |
| 837. | CD70_16xCD 3-scFc | scFv | EVQLLESGGGLVQPGGSLRLSCAASGFTFSSYAMSWVRQSPGKGLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGG GTKVEIK |
| 838. | CD70_16xCD 3-scFc | bispecific molecule | EVQLLESGGGLVQPGGSLRLSCAASGFTFSSYAMSWVRQSPGKGLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGG GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVL |
| 839. | CD70_16xCD 3-scFc | bispecific HLE molecule | EVQLLESGGGLVQPGGSLRLSCAASGFTFSSYAMSWVRQSPGKGLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGG GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGKGGGGSGGGGSGGGGSGGGGSGGGG SGGGGSDKTHTCPPCPAPELLGGPSVFLFPPKPKDTLMISRTPEVTC VVVDVSHEDPEVKFNWYVDGVEVHNAKTKPCEEQYGSTYRCVSVLTV LHQDWLNGKEYKCKVSNKALPAPIEKTISKAKGQPREPQVYTLPPSR EEMTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 840. | CD70_17_CC xCD3-scFc | VH CDR1 | SYAMS |
| 841. | CD70_17_CC xCD3-scFc | VH CDR2 | AISGSGGRTFYAESVEG |
| 842. | CD70_17_CC xCD3-scFc | VH CDR3 | HDYSNYPYFDY |
| 843. | CD70_17_CC xCD3-scFc | VL CDR1 | RASQGVRSDYLA |
| 844. | CD70_17_CC xCD3-scFc | VL CDR2 | GASSRAT |
| 845. | CD70_17_CC xCD3-scFc | VL CDR3 | QQYGSTPPT |
| 846. | CD70_17_CC xCD3-scFc | VH | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCTKHDYSNYPYFDYWGQGTLVTVSS |
| 847. | CD70_17_CC xCD3-scFc | VL | EIVLTQSPGTLSLSPGERATLSCRASQGVRSDYLAWYQQKPGQAPRL LIYGASSRATGIPDRFSGSGSGTDFTLTISRLEPEDFAVYHCQQYGS TPPTFGCGTKVEIK |
| 848. | CD70_17_CC xCD3-scFc | scFv | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCTKHDYSNYPYFDYWGQGTLVTVSSGGGGSGGGGSGGGGSEIVLTQ SPGTLSLSPGERATLSCRASQGVRSDYLAWYQQKPGQAPRLLIYGAS SRATGIPDRFSGSGSGTDFTLTISRLEPEDFAVYHCQQYGSTPPTFG CGTKVEIK |

TABLE 35-continued

| SEQ ID NO: | Designation | Format/ Source | Sequence |
|---|---|---|---|
| Sequence table | | | |
| 849. | CD70_17_CC xCD3-scFc | bispecific molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 850. | CD70_17_CC xCD3-scFc | bispecific HLE molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 851. | CD70_17xCD 3-scFc | VH | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSS |
| 852. | CD70_17xCD 3-scFc | VL | EIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK |
| 853. | CD70_17xCD 3-scFc | scFv | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK |
| 854. | CD70_17xCD 3-scFc | bispecific molecule | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 855. | CD70_17xCD 3-scFc | bispecific HLE molecule | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSD |

TABLE 35-continued

| Sequence table | | | |
|---|---|---|---|
| SEQ ID NO: | Designation | Format/ Source | Sequence |
| | | | IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 856. | CD70_18_CC xCD3-scFc | VH CDR1 | SYAMS |
| 857. | CD70_18_CC xCD3-scFc | VH CDR2 | AIGEGGGYTYYAESVKG |
| 858. | CD70_18_CC xCD3-scFc | VH CDR3 | HDYSNYPYFDY |
| 859. | CD70_18_CC xCD3-scFc | VL CDR1 | RASQGVRSSYFA |
| 860. | CD70_18_CC xCD3-scFc | VL CDR2 | GASTRAT |
| 861. | CD70_18_CC xCD3-scFc | VL CDR3 | QQYGSSPPT |
| 862. | CD70_18_CC xCD3-scFc | VH | EVQLLESGGGLVQPGGSLRLSCAASGFTFSSYAMSWVRQAPGKCLEW VSAIGEGGGYTYYAESVKGRFTISRDNSKNTLSLLMNSLRAEDTAVY YCARHDYSNYPYFDYWGQGTLVTVS |
| 863. | CD70_18_CC xCD3-scFc | VL | EIVLTQSPGTLSLSPGERATLSCRASQGVRSSYFAWYQQKPGQAPRL LIYGASTRATGIPARFSGSGSGTDFTLTISRLEPEDFAVYYCQQYGS SPPTFGCGTKVEIK |
| 864. | CD70_18_CC xCD3-scFc | scFv | EVQLLESGGGLVQPGGSLRLSCAASGFTFSSYAMSWVRQAPGKCLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG CGTKVEIK |
| 865. | CD70_18_CC xCD3-scFc | bispecific molecule | EVQLLESGGGLVQPGGSLRLSCAASGFTFSSYAMSWVRQAPGKCLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 866. | CD70_18_CC xCD3-scFc | bispecific HLE molecule | EVQLLESGGGLVQPGGSLRLSCAASGFTFSSYAMSWVRQAPGKCLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 867. | CD70_18xCD 3-scFc | VH | EVQLLESGGGLVQPGGSLRLSCAASGFTFSSYAMSWVRQAPGKGLEW VSAIGEGGGYTYYAESVKGRFTISRDNSKNTLSLLMNSLRAEDTAVY YCARHDYSNYPYFDYWGQGTLVTVSS |
| 868. | CD70_18xCD 3-scFc | VL | EIVLTQSPGTLSLSPGERATLSCRASQGVRSSYFAWYQQKPGQAPRL LIYGASTRATGIPARFSGSGSGTDFTLTISRLEPEDFAVYYCQQYGS SPPTFGQGTKVEIK |
| 869. | CD70_18xCD 3-scFc | scFv | EVQLLESGGGLVQPGGSLRLSCAASGFTFSSYAMSWVRQAPGKGLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG QGTKVEIK |
| 870. | CD70_18xCD 3-scFc | bispecific molecule | EVQLLESGGGLVQPGGSLRLSCAASGFTFSSYAMSWVRQAPGKGLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG QGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 871. | CD70_18xCD 3-scFc | bispecific HLE molecule | EVQLLESGGGLVQPGGSLRLSCAASGFTFSSYAMSWVRQAPGKGLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG QGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 872. | CD70_19_CC xCD3-scFc | VH CDR1 | SYAMS |
| 873. | CD70_19_CC xCD3-scFc | VH CDR2 | AISGSGGRTFYAESVEG |
| 874. | CD70_19_CC xCD3-scFc | VH CDR3 | HDYSNYPYFDY |
| 875. | CD70_19_CC xCD3-scFc | VL CDR1 | RASQSIRSNYLA |
| 876. | CD70_19_CC xCD3-scFc | VL CDR2 | GASSRAT |
| 877. | CD70_19_CC xCD3-scFc | VL CDR3 | QQYGSSPPS |
| 878. | CD70_19_CC xCD3-scFc | VH | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSS |
| 879. | CD70_19_CC xCD3-scFc | VL | EIVLTQSPGTLSLSPGERATLSCRASQSIRSNYLAWYQQKPGQAPRL LIYGASSRATGIPDRFSGSGSGTDFTLTISRLEPEDFAVYYCQQYGS SPPSFGCGTKVEIK |

TABLE 35-continued

Sequence table

| SEQ ID NO: | Designation | Format/ Source | Sequence |
|---|---|---|---|
| 880. | CD70_19_CC xCD3-scFc | scFv | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG CGTKVEIK |
| 881. | CD70_19_CC xCD3-scFc | bispecific molecule | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 882. | CD70_19_CC xCD3-scFc | bispecific HLE molecule | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 883. | CD70_19xCD 3-scFc | VH | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 884. | CD70_19xCD 3-scFc | VL | EIVLTQSPGTLSLSPGERATLSCRASQSIRSNYLAWYQQKPGQAPRL LIYGASSRATGIPDRFSGSGSGTDFTLTISRLEPEDFAVYYCQQYGS SPPSFGQGTKVEIK |
| 885. | CD70_19xCD 3-scFc | scFv | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG QGTKVEIK |
| 886. | CD70_19xCD 3-scFc | bispecific molecule | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG QGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 887. | CD70_19xCD 3-scFc | bispecific HLE molecule | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG QGTKVEIKSGGGGSEVQLVESGGGLVQPGGSLKLSCAASGFTFNKYA MNWVRQAPGKGLEWVARIRSKYNNYATYYADSVKDRFTISRDDSKNT |

TABLE 35-continued

Sequence table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 888. | CD70_20_CC xCD3-scFc | VH CDR1 | SYAMS |
| 889. | CD70_20_CC xCD3-scFc | VH CDR2 | AISGSGGGTFYAESVEG |
| 890. | CD70_20_CC xCD3-scFc | VH CDR3 | HDYSNYPYFDY |
| 891. | CD70_20_CC xCD3-scFc | VL CDR1 | RASQSVRSSYLA |
| 892. | CD70_20_CC xCD3-scFc | VL CDR2 | GASSRAT |
| 893. | CD70_20_CC xCD3-scFc | VL CDR3 | QQYGDLPFT |
| 894. | CD70_20_CC xCD3-scFc | VH | EVQLLESGGGVVQPGRSLRLSCAASGFTFSSYAMSWVRQAPGKCLEW VSAISGSGGGTFYAESVEGRFTISRDNSKNTLYLQMNSLRAEDTAVY YCARHDYSNYPYFDYWGLGTLVTVSS |
| 895. | CD70_20_CC xCD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYSCQQYGD LPFTFGCGTKVEIK |
| 896. | CD70_20_CC xCD3-scFc | scFv | EVQLLESGGGVVQPGRSLRLSCAASGFTFSSYAMSWVRQAPGKCLEW VSAISGSGGGTFYAESVEGRFTISRDNSKNTLYLQMNSLRAEDTAVY YCARHDYSNYPYFDYWGLGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYSCQQYGDLPFTFG CGTKVEIK |
| 897. | CD70_20_CC xCD3-scFc | bispecific molecule | EVQLLESGGGVVQPGRSLRLSCAASGFTFSSYAMSWVRQAPGKCLEW VSAISGSGGGTFYAESVEGRFTISRDNSKNTLYLQMNSLRAEDTAVY YCARHDYSNYPYFDYWGLGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYSCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 898. | CD70_20_CC xCD3-scFc | bispecific HLE molecule | EVQLLESGGGVVQPGRSLRLSCAASGFTFSSYAMSWVRQAPGKCLEW VSAISGSGGGTFYAESVEGRFTISRDNSKNTLYLQMNSLRAEDTAVY YCARHDYSNYPYFDYWGLGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYSCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF |

TABLE 35-continued

| Sequence table | | | |
|---|---|---|---|
| SEQ ID NO: | Designation | Format/ Source | Sequence |
| | | | SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 899. | CD70_20xCD 3-scFc | VH | EVQLLESGGGVVQPGRSLRLSCAASGFTFSSYAMSWVRQAPGKGLEW VSAISGSGGGTFYAESVEGRFTISRDNSKNTLYLQMNSLRAEDTAVY YCARHDYSNYPYFDYWGLGTLVTVSS |
| 900. | CD70_20xCD 3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYSCQQYGD LPFTFGPGTKVEIK |
| 901. | CD70_20xCD 3-scFc | scFv | EVQLLESGGGVVQPGRSLRLSCAASGFTFSSYAMSWVRQAPGKGLEW VSAISGSGGGTFYAESVEGRFTISRDNSKNTLYLQMNSLRAEDTAVY YCARHDYSNYPYFDYWGLGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYSCQQYGDLPFTFG PGTKVEIK |
| 902. | CD70_20xCD 3-scFc | bispecific molecule | EVQLLESGGGVVQPGRSLRLSCAASGFTFSSYAMSWVRQAPGKGLEW VSAISGSGGGTFYAESVEGRFTISRDNSKNTLYLQMNSLRAEDTAVY YCARHDYSNYPYFDYWGLGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYSCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 903. | CD70_20xCD 3-scFc | bispecific HLE molecule | EVQLLESGGGVVQPGRSLRLSCAASGFTFSSYAMSWVRQAPGKGLEW VSAISGSGGGTFYAESVEGRFTISRDNSKNTLYLQMNSLRAEDTAVY YCARHDYSNYPYFDYWGLGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYSCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 904. | CD70_21_CC xCD3-scFc | VH CDR1 | SYAMS |
| 905. | CD70_21_CC xCD3-scFc | VH CDR2 | AISGSGGRTFYAESVEG |
| 906. | CD70_21_CC xCD3-scFc | VH CDR3 | HDYSNYPYFDY |
| 907. | CD70_21_CC xCD3-scFc | VL CDR1 | RASQSVRSSYLA |
| 908. | CD70_21_CC xCD3-scFc | VL CDR2 | GASSRAT |
| 909. | CD70_21_CC xCD3-scFc | VL CDR3 | QQYGDLPFT |

TABLE 35-continued

| Sequence table | | | |
|---|---|---|---|
| SEQ ID NO: | Designation | Format/ Source | Sequence |
| 910. | CD70_21_CC xCD3-scFc | VH | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSS |
| 911. | CD70_21_CC xCD3-scFc | VL | EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK |
| 912. | CD70_21_CC xCD3-scFc | scFv | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK |
| 913. | CD70_21_CC xCD3-scFc | bispecific molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 914. | CD70_21_CC xCD3-scFc | bispecific HLE molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 915. | CD70_21xCD 3-scFc | VH | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSS |
| 916. | CD70_21xCD 3-scFc | VL | EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK |
| 917. | CD70_21xCD 3-scFc | scFv | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK |
| 918. | CD70_21xCD 3-scFc | bispecific molecule | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNT |

TABLE 35-continued

Sequence table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 919. | CD70_21xCD 3-scFc | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCTKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 920. | CD70_22_CC xCD3-scFc | VH CDR1 | TYAMS |
| 921. | CD70_22_CC xCD3-scFc | VH CDR2 | LISGSGGRTYYAESVKG |
| 922. | CD70_22_CC xCD3-scFc | VH CDR3 | HDYSNYPYFDY |
| 923. | CD70_22_CC xCD3-scFc | VL CDR1 | RASQGVRSSYLA |
| 924. | CD70_22_CC xCD3-scFc | VL CDR2 | GASSRAT |
| 925. | CD70_22_CC xCD3-scFc | VL CDR3 | QQYGSSPPT |
| 926. | CD70_22_CC xCD3-scFc | VH | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSS |
| 927. | CD70_22_CC xCD3-scFc | VL | EIVLTQSPGTLSLSPGERATLSCRASQGVRSSYLAWYQQKPGQAPRL LIYGASSRATGIPDRFSGSGSGTDFTLTINRLEPEDFAVYYCQQYGS SPPTFGCGTKVDIK |
| 928. | CD70_22_CC xCD3-scFc | scFv | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG CGTKVDIK |
| 929. | CD70_22_CC xCD3-scFc | bispecific molecule | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 35-continued

Sequence table

| SEQ ID NO: | Designation | Format/ Source | Sequence |
|---|---|---|---|
| 930. | CD70_22_CC xCD3-scFc | bispecific HLE molecule | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 931. | CD70_22xCD 3-scFc | VH | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSS |
| 932. | CD70_22xCD 3-scFc | VL | EIVLTQSPGTLSLSPGERATLSCRASQGVRSSYLAWYQQKPGQAPRL LIYGASSRATGIPDRFSGSGSGTDFTLTINRLEPEDFAVYYCQQYGS SPPTFGGGTKVDIK |
| 933. | CD70_22xCD 3-scFc | scFv | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG GGTKVDIK |
| 934. | CD70_22xCD 3-scFc | bispecific molecule | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG GGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 935. | CD70_22xCD 3-scFc | bispecific HLE molecule | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG GGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 936. | CD70_23_CC xCD3-scFc | VH CDR1 | SYAMS |
| 937. | CD70_23_CC xCD3-scFc | VH CDR2 | AISGSGGRTFYAESVEG |
| 938. | CD70_23_CC xCD3-scFc | VH CDR3 | HDYSNYPYFDY |
| 939. | CD70_23_CC xCD3-scFc | VL CDR1 | RASQSVRSNYLA |
| 940. | CD70_23_CC xCD3-scFc | VL CDR2 | GASSRAT |
| 941. | CD70_23_CC xCD3-scFc | VL CDR3 | QQYGSSPPT |
| 942. | CD70_23_CC xCD3-scFc | VH | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSS |
| 943. | CD70_23_CC xCD3-scFc | VL | EIVLTQSPGTLSLSPGERATLSCRASQSVRSNYLAWYQQKPGQAPRL LIYGASSRATGIPDRFSGSGSGTDFTLTINRLEPEDFAVYYCQQYGS SPPTFGCGTKVDIK |
| 944. | CD70_23_CC xCD3-scFc | scFv | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTINRLEPEDFAVYYCQQYGSSPPTFG CGTKVDIK |
| 945. | CD70_23_CC xCD3-scFc | bispecific molecule | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTINRLEPEDFAVYYCQQYGSSPPTFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 946. | CD70_23_CC xCD3-scFc | bispecific HLE molecule | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTINRLEPEDFAVYYCQQYGSSPPTFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 947. | CD70_23xCD 3-scFc | VH | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 948. | CD70_23xCD 3-scFc | VL | EIVLTQSPGTLSLSPGERATLSCRASQSVRSNYLAWYQQKPGQAPRL LIYGASSRATGIPDRFSGSGSGTDFTLTINRLEPEDFAVYYCQQYGS SPPTFGGGTKVDIK |

TABLE 35-continued

| SEQ ID NO: | Designation | Format/ Source | Sequence |
|---|---|---|---|
| 949. | CD70_23xCD 3-scFc | scFv | EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK |
| 950. | CD70_23xCD 3-scFc | bispecific molecule | EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 951. | CD70_23xCD 3-scFc | bispecific HLE molecule | EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 952. | CD70_24_CC xCD3-scFc | VH CDR1 | SYAMS |
| 953. | CD70_24_CC xCD3-scFc | VH CDR2 | VISGSGGITDFAESVKG |
| 954. | CD70_24_CC xCD3-scFc | VH CDR3 | HDYSNYFFFDY |
| 955. | CD70_24_CC xCD3-scFc | VL CDR1 | RASQGISNYLA |
| 956. | CD70_24_CC xCD3-scFc | VL CDR2 | AASILQS |
| 957. | CD70_24_CC xCD3-scFc | VL CDR3 | QQYFAYPIT |
| 958. | CD70_24_CC xCD3-scFc | VH | EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSS |
| 959. | CD70_24_CC xCD3-scFc | VL | DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK |
| 960. | CD70_24_CC xCD3-scFc | scFv | EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK |

TABLE 35-continued

Sequence table

| SEQ ID NO: | Designation | Format/ Source | Sequence |
|---|---|---|---|
| 961. | CD70_24_CC xCD3-scFc | bispecific molecule | EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 962. | CD70_24_CC xCD3-scFc | bispecific HLE molecule | EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 963. | CD70_24xCD 3-scFc | VH | EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSS |
| 964. | CD70_24xCD 3-scFc | VL | DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK |
| 965. | CD70_24xCD 3-scFc | scFv | EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK |
| 966. | CD70_24xCD 3-scFc | bispecific molecule | EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 967. | CD70_24xCD 3-scFc | bispecific HLE molecule | EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDI |

TABLE 35-continued

Sequence table

| SEQ ID NO: | Designation | Format/ Source | Sequence |
|---|---|---|---|
| | | | AVEWESNGQPENNYKTTPPVLDSDGSFFLYSKLTVDKSRWQQGNVFS CSVMHEALHNHYTQKSLSLSPGKGGGGSGGGGSGGGGSGGGGSGGGG SGGGGSDKTHTCPPCPAPELLGGPSVFLFPPKPKDTLMISRTPEVTC VVVDVSHEDPEVKFNWYVDGVEVHNAKTKPCEEQYGSTYRCVSVLTV LHQDWLNGKEYKCKVSNKALPAPIEKTISKAKGQPREPQVYTLPPSR EEMTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 968. | CD70_25_CC xCD3-scFc | VH CDR1 | SYAMS |
| 969. | CD70_25_CC xCD3-scFc | VH CDR2 | AISGSGGRTFYAESVEG |
| 970. | CD70_25_CC xCD3-scFc | VH CDR3 | HDYSNYPYFDY |
| 971. | CD70_25_CC xCD3-scFc | VL CDR1 | RASQSVRSSYLA |
| 972. | CD70_25_CC xCD3-scFc | VL CDR2 | GASSRAT |
| 973. | CD70_25_CC xCD3-scFc | VL CDR3 | QQYGSSPPT |
| 974. | CD70_25_CC xCD3-scFc | VH | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSS |
| 975. | CD70_25_CC xCD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYFCQQYGS SPPTFGCGTRLEIK |
| 976. | CD70_25_CC xCD3-scFc | scFv | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG CGTRLEIK |
| 977. | CD70_25_CC xCD3-scFc | bispecific molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG CGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 978. | CD70_25_CC xCD3-scFc | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG CGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| 979. | CD70_25xCD 3-scFc | VH | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSS |
| 980. | CD70_25xCD 3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYFCQQYGS SPPTFGGGTRLEIK |
| 981. | CD70_25xCD 3-scFc | scFv | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG GGTRLEIK |
| 982. | CD70_25xCD 3-scFc | bispecific molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG GGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 983. | CD70_25xCD 3-scFc | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG GGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 984. | CD70_26_CC xCD3-scFc | VH CDR1 | IYAMS |
| 985. | CD70_26_CC xCD3-scFc | VH CDR2 | AIGGSGGSTFYAESVKG |
| 986. | CD70_26_CC xCD3-scFc | VH CDR3 | HDYSNYPYFDY |
| 987. | CD70_26_CC xCD3-scFc | VL CDR1 | RASQSVRSSYVA |
| 988. | CD70_26_CC xCD3-scFc | VL CDR2 | GASSRAT |
| 989. | CD70_26_CC xCD3-scFc | VL CDR3 | QQYGDLPFT |
| 990. | CD70_26_CC xCD3-scFc | VH | EVQLLESGGGLVQPGGSLRLSCAASGFTFSIYAMSWVRQAPGKCLEW VSAIGGSGGSTFYAESVKGRFTISRDNSKNTLYLQMNSLRAEDTAVY YCAKHDYSNYPYFDYWGQGTLVTVSS |
| 991. | CD70_26_CC xCD3-scFc | VL | EIVLTQSPGTLSLSPGERATLSCRASQSVRSSYVAWYQQKPGQAPRL LIYGASSRATGIPDRFSGSGSGTDFTLTISRLEPEDFAVYYCQQYGD LPFTFGCGTRLEIK |

TABLE 35-continued

| Sequence table | | | |
|---|---|---|---|
| SEQ ID NO: | Designation | Format/ Source | Sequence |
| 992. | CD70_26_CC xCD3-scFc | scFv | EVQLLESGGGLVQPGGSLRLSCAASGFTFSIYAMSWVRQAPGKCLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG CGTRLEIK |
| 993. | CD70_26_CC xCD3-scFc | bispecific molecule | EVQLLESGGGLVQPGGSLRLSCAASGFTFSIYAMSWVRQAPGKCLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG CGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 994. | CD70_26_CC xCD3-scFc | bispecific HLE molecule | EVQLLESGGGLVQPGGSLRLSCAASGFTFSIYAMSWVRQAPGKCLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG CGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 995. | CD70_26xCD 3-scFc | VH | EVQLLESGGGLVQPGGSLRLSCAASGFTFSIYAMSWVRQAPGKGLEW VSAIGGSGGSTFYAESVKGRFTISRDNSKNTLYLQMNSLRAEDTAVY YCAKHDYSNYPYFDYWGQGTLVTVSS |
| 996. | CD70_26xCD 3-scFc | VL | EIVLTQSPGTLSLSPGERATLSCRASQSVRSSYVAWYQQKPGQAPRL LIYGASSRATGIPDRFSGSGSGTDFTLTISRLEPEDFAVYYCQQYGD LPFTFGPGTRLEIK |
| 997. | CD70_26xCD 3-scFc | scFv | EVQLLESGGGLVQPGGSLRLSCAASGFTFSIYAMSWVRQAPGKGLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG PGTRLEIK |
| 998. | CD70_26xCD 3-scFc | bispecific molecule | EVQLLESGGGLVQPGGSLRLSCAASGFTFSIYAMSWVRQAPGKGLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG PGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 999. | CD70_26xCD 3-scFc | bispecific HLE molecule | EVQLLESGGGLVQPGGSLRLSCAASGFTFSIYAMSWVRQAPGKGLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG PGTRLEIKSGGGGSEVQLVESGGGLVQPGGSLKLSCAASGFTFNKYA MNWVRQAPGKGLEWVARIRSKYNNYATYYADSVKDRFTISRDDSKNT |

TABLE 35-continued

| Sequence table | | | |
|---|---|---|---|
| SEQ ID NO: | Designation | Format/ Source | Sequence |
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 1000 | CD70_27_CC xCD3-scFc | VH CDR1 | SSSYYWG |
| 1001 | CD70_27_CC xCD3-scFc | VH CDR2 | SIYHSGGTYFNPSLKS |
| 1002 | CD70_27_CC xCD3-scFc | VH CDR3 | HYEILTGYYPDVFDI |
| 1003 | CD70_27_CC xCD3-scFc | VL CDR1 | RASQSISSYLN |
| 1004 | CD70_27_CC xCD3-scFc | VL CDR2 | AASNLOS |
| 1005 | CD70_27_CC xCD3-scFc | VL CDR3 | QQSFSSPRT |
| 1006 | CD70_27_CC xCD3-scFc | VH | QVQLQESGPGLVKPSQTLSLTCTVSGGSISSSSYYWGWIRQPPGKCL EWIGSIYHSGGTYFNPSLKSRVTISVDTSKNQFSLKLSSVTAADTAV YYCARHYEILTGYYPDVFDIWGQGTMVTVSS |
| 1007 | CD70_27_CC xCD3-scFc | VL | DIQMTQSPSSLSASVGDRVTITCRASQSISSYLNWYQQKPGKAPKLL IYAASNLQSGVSSRFSGSGSGTDFTLTISSLQPEDFATYYCQQSFSS PRTFGCGTKVEIK |
| 1008 | CD70_27_CC xCD3-scFc | scFv | QVQLQESGPGLVKPSQTLSLTCTVSGGSISSSSYYWGWIRQPPGKCL EWIGSIYHSGGTYFNPSLKSRVTISVDTSKNQFSLKLSSVTAADTAV YYCARHYEILTGYYPDVFDIWGQGTMVTVSSGGGGSGGGGSGGGGSD IQMTQSPSSLSASVGDRVTITCRASQSISSYLNWYQQKPGKAPKLLI YAASNLQSGVSSRFSGSGSGTDFTLTISSLQPEDFATYYCQQSFSSP RTFGCGTKVEIK |
| 1009 | CD70_27_CC xCD3-scFc | bispecific molecule | QVQLQESGPGLVKPSQTLSLTCTVSGGSISSSSYYWGWIRQPPGKCL EWIGSIYHSGGTYFNPSLKSRVTISVDTSKNQFSLKLSSVTAADTAV YYCARHYEILTGYYPDVFDIWGQGTMVTVSSGGGGSGGGGSGGGGSD IQMTQSPSSLSASVGDRVTITCRASQSISSYLNWYQQKPGKAPKLLI YAASNLQSGVSSRFSGSGSGTDFTLTISSLQPEDFATYYCQQSFSSP RTFGCGTKVEIKSGGGGSEVQLVESGGGLVQPGGSLKLSCAASGFTF NKYAMNWVRQAPGKGLEWVARIRSKYNNYATYYADSVKDRFTISRDD SKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVT SGNYPNWVQQKPGQAPRGLIGGTKFLAPGTPARFSGSLLGGKAALTL SGVQPEDEAEYYCVLWYSNRWVFGGGTKLTVL |
| 1010 | CD70_27_CC xCD3-scFc | bispecific HLE molecule | QVQLQESGPGLVKPSQTLSLTCTVSGGSISSSSYYWGWIRQPPGKCL EWIGSIYHSGGTYFNPSLKSRVTISVDTSKNQFSLKLSSVTAADTAV YYCARHYEILTGYYPDVFDIWGQGTMVTVSSGGGGSGGGGSGGGGSD IQMTQSPSSLSASVGDRVTITCRASQSISSYLNWYQQKPGKAPKLLI YAASNLQSGVSSRFSGSGSGTDFTLTISSLQPEDFATYYCQQSFSSP RTFGCGTKVEIKSGGGGSEVQLVESGGGLVQPGGSLKLSCAASGFTF NKYAMNWVRQAPGKGLEWVARIRSKYNNYATYYADSVKDRFTISRDD SKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVT SGNYPNWVQQKPGQAPRGLIGGTKFLAPGTPARFSGSLLGGKAALTL SGVQPEDEAEYYCVLWYSNRWVFGGGTKLTVLGGGGDKTHTCPPCPA PELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ |

TABLE 35-continued

Sequence table

| SEQ ID NO: | Designation | Format/ Source | Sequence |
|---|---|---|---|
| | | | GNVFSCSVMHEALHNHYTQKSLSLSPGKGGGGSGGGGSGGGGSGGGG SGGGGSGGGGSDKTHTCPPCPAPELLGGPSVFLFPPKPKDTLMISRT PEVTCVVVDVSHEDPEVKFNWYVDGVEVHNAKTKPCEEQYGSTYRCV SVLTVLHQDWLNGKEYKCKVSNKALPAPIEKTISKAKGQPREPQVYT LPPSREEMTKNQVSLTCLVKGFYPSDIAVEWESNGQPENNYKTTPPV LDSDGSFFLYSKLTVDKSRWQQGNVFSCSVMHEALHNHYTQKSLSLS PGK |
| 1011 | CD70_27xCD 3-scFc | VH | QVQLQESGPGLVKPSQTLSLTCTVSGGSISSSSYYWGWIRQPPGKGL EWIGSIYHSGGTYFNPSLKSRVTISVDTSKNQFSLKLSSVTAADTAV YYCARHYEILTGYYPDVFDIWGQGTMVTVSS |
| 1012 | CD70_27xCD 3-scFc | VL | DIQMTQSPSSLSASVGDRVTITCRASQSISSYLNWYQQKPGKAPKLL IYAASNLQSGVSSRFSGSGSGTDFTLTISSLQPEDFATYYCQQSFSS PRTFGQGTKVEIK |
| 1013 | CD70_27xCD 3-scFc | scFv | QVQLQESGPGLVKPSQTLSLTCTVSGGSISSSSYYWGWIRQPPGKGL EWIGSIYHSGGTYFNPSLKSRVTISVDTSKNQFSLKLSSVTAADTAV YYCARHYEILTGYYPDVFDIWGQGTMVTVSSGGGGSGGGGSGGGGSD IQMTQSPSSLSASVGDRVTITCRASQSISSYLNWYQQKPGKAPKLLI YAASNLQSGVSSRFSGSGSGTDFTLTISSLQPEDFATYYCQQSFSSP RTFGQGTKVEIK |
| 1014 | CD70_27xCD 3-scFc | bispecific molecule | QVQLQESGPGLVKPSQTLSLTCTVSGGSISSSSYYWGWIRQPPGKGL EWIGSIYHSGGTYFNPSLKSRVTISVDTSKNQFSLKLSSVTAADTAV YYCARHYEILTGYYPDVFDIWGQGTMVTVSSGGGGSGGGGSGGGGSD IQMTQSPSSLSASVGDRVTITCRASQSISSYLNWYQQKPGKAPKLLI YAASNLQSGVSSRFSGSGSGTDFTLTISSLQPEDFATYYCQQSFSSP RTFGQGTKVEIKSGGGGSEVQLVESGGGLVQPGGSLKLSCAASGFTF NKYAMNWVRQAPGKGLEWVARIRSKYNNYATYYADSVKDRFTISRDD SKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVT SGNYPNWVQQKPGQAPRGLIGGTKFLAPGTPARFSGSLLGGKAALTL SGVQPEDEAEYYCVLWYSNRWVFGGGTKLTVL |
| 1015 | CD70_27xCD 3-scFc | bispecific HLE molecule | QVQLQESGPGLVKPSQTLSLTCTVSGGSISSSSYYWGWIRQPPGKGL EWIGSIYHSGGTYFNPSLKSRVTISVDTSKNQFSLKLSSVTAADTAV YYCARHYEILTGYYPDVFDIWGQGTMVTVSSGGGGSGGGGSGGGGSD IQMTQSPSSLSASVGDRVTITCRASQSISSYLNWYQQKPGKAPKLLI YAASNLQSGVSSRFSGSGSGTDFTLTISSLQPEDFATYYCQQSFSSP RTFGQGTKVEIKSGGGGSEVQLVESGGGLVQPGGSLKLSCAASGFTF NKYAMNWVRQAPGKGLEWVARIRSKYNNYATYYADSVKDRFTISRDD SKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVT SGNYPNWVQQKPGQAPRGLIGGTKFLAPGTPARFSGSLLGGKAALTL SGVQPEDEAEYYCVLWYSNRWVFGGGTKLTVLGGGGDKTHTCPPCPA PELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPGKGGGGSGGGGSGGGGSGGGG SGGGGSGGGGSDKTHTCPPCPAPELLGGPSVFLFPPKPKDTLMISRT PEVTCVVVDVSHEDPEVKFNWYVDGVEVHNAKTKPCEEQYGSTYRCV SVLTVLHQDWLNGKEYKCKVSNKALPAPIEKTISKAKGQPREPQVYT LPPSREEMTKNQVSLTCLVKGFYPSDIAVEWESNGQPENNYKTTPPV LDSDGSFFLYSKLTVDKSRWQQGNVFSCSVMHEALHNHYTQKSLSLS PGK |
| 1016 | CD70_28_CC xCD3-scFc | VH CDR1 | SYSMN |
| 1017 | CD70_28_CC xCD3-scFc | VH CDR2 | YISSSGGYIYYAESVKG |
| 1018 | CD70_28_CC xCD3-scFc | VH CDR3 | GDYSNYAYFDY |
| 1019 | CD70_28_CC xCD3-scFc | VL CDR1 | RASQGISNYLA |
| 1020 | CD70_28_CC xCD3-scFc | VL CDR2 | AASTLQS |
| 1021 | CD70_28_CC xCD3-scFc | VL CDR3 | QQYYSTPLT |

TABLE 35-continued

Sequence table

| SEQ ID NO: | Designation | Format/ Source | Sequence |
|---|---|---|---|
| 1022 | CD70_28_CC xCD3-scFc | VH | EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSS |
| 1023 | CD70_28_CC xCD3-scFc | VL | DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK |
| 1024 | CD70_28_CC xCD3-scFc | scFv | EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK |
| 1025 | CD70_28_CC xCD3-scFc | bispecific molecule | EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1026 | CD70_28_CC xCD3-scFc | bispecific HLE molecule | EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1027 | CD70_28xCD 3-scFc | VH | EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSS |
| 1028 | CD70_28xCD 3-scFc | VL | DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK |
| 1029 | CD70_28xCD 3-scFc | scFv | EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK |
| 1030 | CD70_28xCD 3-scFc | bispecific molecule | EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQP |

TABLE 35-continued

| SEQ ID NO: | Designation | Format/ Source | Sequence |
|---|---|---|---|
| | | | EDEAEYYCVLWYSNRWVFGGGTKLTVL |
| 1031 | CD70_28xCD 3-scFc | bispecific HLE molecule | EVQLVESGGGLVKPGGSLRLSCAASGFTFSSYSMNWVRQAPGKGLEW VSYISSSGGYIYYAESVKGRFTISRDNAKNSLYLQMNSLRAEDAAVY YCSRGDYSNYAYFDYWGQGTLVTVSSGGGGSGGGGSGGGGSDIQMTQ SPSSLSASVGDRVTITCRASQGISNYLAWYQQKPGKVPKLLIYAAST LQSGVPSRFSGSGSGTDFTLTISSLQAEDVAVYYCQQYYSTPLTFGG GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGKGGGGSGGGGSGGGGSGGGGSGGGG SGGGGSDKTHTCPPCPAPELLGGPSVFLFPPKPKDTLMISRTPEVTC VVVDVSHEDPEVKFNWYVDGVEVHNAKTKPCEEQYGSTYRCVSVLTV LHQDWLNGKEYKCKVSNKALPAPIEKTISKAKGQPREPQVYTLPPSR EEMTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 1032 | CD70_29_CC xCD3-scFc | VH CDR1 | VYAMS |
| 1033 | CD70_29_CC xCD3-scFc | VH CDR2 | TISGSGGSTFYAESVKG |
| 1034 | CD70_29_CC xCD3-scFc | VH CDR3 | HDYSNYAYFDY |
| 1035 | CD70_29_CC xCD3-scFc | VL CDR1 | RASQSVRSSYLA |
| 1036 | CD70_29_CC xCD3-scFc | VL CDR2 | GASSRAT |
| 1037 | CD70_29_CC xCD3-scFc | VL CDR3 | QQYGDLPFT |
| 1038 | CD70_29_CC xCD3-scFc | VH | EVQLLESGGGLVQPGGSLRLSCAASGFTFSVYAMSWVRQAPGKCLEW VSTISGSGGSTFYAESVKGRFTISRDNSKNTLYLQMNRLRAEDTAVY YCARHDYSNYAYFDYWGQGTLVTVSS |
| 1039 | CD70_29_CC xCD3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGCGTKVEIK |
| 1040 | CD70_29_CC xCD3-scFc | scFv | EVQLLESGGGLVQPGGSLRLSCAASGFTFSVYAMSWVRQAPGKCLEW VSTISGSGGSTFYAESVKGRFTISRDNSKNTLYLQMNRLRAEDTAVY YCARHDYSNYAYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKVEIK |
| 1041 | CD70_29_CC xCD3-scFc | bispecific molecule | EVQLLESGGGLVQPGGSLRLSCAASGFTFSVYAMSWVRQAPGKCLEW VSTISGSGGSTFYAESVKGRFTISRDNSKNTLYLQMNRLRAEDTAVY YCARHDYSNYAYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 1042 | CD70_29_CC xCD3-scFc | bispecific HLE molecule | EVQLLESGGGLVQPGGSLRLSCAASGFTFSVYAMSWVRQAPGKCLEW VSTISGSGGSTFYAESVKGRFTISRDNSKNTLYLQMNRLRAEDTAVY YCARHDYSNYAYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA |

TABLE 35-continued

| SEQ ID NO: | Designation | Format/ Source | Sequence |
|---|---|---|---|
| | | | MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 1043 | CD70_29xCD 3-scFc | VH | EVQLLESGGGLVQPGGSLRLSCAASGFTFSVYAMSWVRQAPGKGLEW VSTISGSGGSTFYAESVKGRFTISRDNSKNTLYLQMNRLRAEDTAVY YCARHDYSNYAYFDYWGQGTLVTVSS |
| 1044 | CD70_29xCD 3-scFc | VL | EIVLTQSPGTLSLSPGERATLSCRASQSVRSSYLAWYQQKPGQAPRL LIYGASSRATGIPDRFSGSGSGTDFTLTISRLEPEDFAVYYCQQYGD LPFTFGPGTKVEIK |
| 1045 | CD70_29xCD 3-scFc | scFv | EVQLLESGGGLVQPGGSLRLSCAASGFTFSVYAMSWVRQAPGKGLEW VSTISGSGGSTFYAESVKGRFTISRDNSKNTLYLQMNRLRAEDTAVY YCARHDYSNYAYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIK |
| 1046 | CD70_29xCD 3-scFc | bispecific molecule | EVQLLESGGGLVQPGGSLRLSCAASGFTFSVYAMSWVRQAPGKGLEW VSTISGSGGSTFYAESVKGRFTISRDNSKNTLYLQMNRLRAEDTAVY YCARHDYSNYAYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 1047 | CD70_29xCD 3-scFc | bispecific HLE molecule | EVQLLESGGGLVQPGGSLRLSCAASGFTFSVYAMSWVRQAPGKGLEW VSTISGSGGSTFYAESVKGRFTISRDNSKNTLYLQMNRLRAEDTAVY YCARHDYSNYAYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 1048 | CD70_30_CC xCD3-scFc | VH CDR1 | SYGMH |
| 1049 | CD70_30_CC xCD3-scFc | VH CDR2 | VISYEGSNKYYAESVKG |
| 1050 | CD70_30_CC xCD3-scFc | VH CDR3 | GRYYGSGNYNHGMDV |

TABLE 35-continued

Sequence table

| SEQ ID NO: | Designation | Format/ Source | Sequence |
|---|---|---|---|
| 1051 | CD70_30_CC xCD3-scFc | VL CDR1 | RASQSISSYLN |
| 1052 | CD70_30_CC xCD3-scFc | VL CDR2 | AASSLQS |
| 1053 | CD70_30_CC xCD3-scFc | VL CDR3 | QQSYSTPFT |
| 1054 | CD70_30_CC xCD3-scFc | VH | QVQLVESGGGVVQPGRSLRLSCAASGFMFSSYGMHWVRQAPGKCLEW VAVISYEGSNKYYAESVKGRFTISRDNSKNTLYLQMNSLRAEDTAVY YCARGRYYGSGNYNHGMDVWGQGTTVTVSS |
| 1055 | CD70_30_CC xCD3-scFc | VL | DIQMTQSPSSLSASVGDRVTITCRASQSISSYLNWYQQKPGKAPKLL IYAASSLQSGVPSRFSGRGSGTDFTLTISSLQPEDFATYYCQQSYST PFTFGCGTKVEIK |
| 1056 | CD70_30_CC xCD3-scFc | scFv | QVQLVESGGGVVQPGRSLRLSCAASGFMFSSYGMHWVRQAPGKCLEW VAVISYEGSNKYYAESVKGRFTISRDNSKNTLYLQMNSLRAEDTAVY YCARGRYYGSGNYNHGMDVWGQGTTVTVSSGGGGSGGGGSGGGGSDI QMTQSPSSLSASVGDRVTITCRASQSISSYLNWYQQKPGKAPKLLIY AASSLQSGVPSRFSGRGSGTDFTLTISSLQPEDFATYYCQQSYSTPF TFGCGTKVEIK |
| 1057 | CD70_30_CC xCD3-scFc | bispecific molecule | QVQLVESGGGVVQPGRSLRLSCAASGFMFSSYGMHWVRQAPGKCLEW VAVISYEGSNKYYAESVKGRFTISRDNSKNTLYLQMNSLRAEDTAVY YCARGRYYGSGNYNHGMDVWGQGTTVTVSSGGGGSGGGGSGGGGSDI QMTQSPSSLSASVGDRVTITCRASQSISSYLNWYQQKPGKAPKLLIY AASSLQSGVPSRFSGRGSGTDFTLTISSLQPEDFATYYCQQSYSTPF TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 1058 | CD70_30_CC xCD3-scFc | bispecific HLE molecule | QVQLVESGGGVVQPGRSLRLSCAASGFMFSSYGMHWVRQAPGKCLEW VAVISYEGSNKYYAESVKGRFTISRDNSKNTLYLQMNSLRAEDTAVY YCARGRYYGSGNYNHGMDVWGQGTTVTVSSGGGGSGGGGSGGGGSDI QMTQSPSSLSASVGDRVTITCRASQSISSYLNWYQQKPGKAPKLLIY AASSLQSGVPSRFSGRGSGTDFTLTISSLQPEDFATYYCQQSYSTPF TFGCGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 1059 | CD70_30xCD 3-scFc | VH | QVQLVESGGGVVQPGRSLRLSCAASGFMFSSYGMHWVRQAPGKGLEW VAVISYEGSNKYYAESVKGRFTISRDNSKNTLYLQMNSLRAEDTAVY YCARGRYYGSGNYNHGMDVWGQGTTVTVSS |
| 1060 | CD70_30xCD 3-scFc | VL | DIQMTQSPSSLSASVGDRVTITCRASQSISSYLNWYQQKPGKAPKLL IYAASSLQSGVPSRFSGRGSGTDFTLTISSLQPEDFATYYCQQSYST PFTFGPGTKVEIK |
| 1061 | CD70_30xCD 3-scFc | scFv | QVQLVESGGGVVQPGRSLRLSCAASGFMFSSYGMHWVRQAPGKGLEW VAVISYEGSNKYYAESVKGRFTISRDNSKNTLYLQMNSLRAEDTAVY YCARGRYYGSGNYNHGMDVWGQGTTVTVSSGGGGSGGGGSGGGGSDI QMTQSPSSLSASVGDRVTITCRASQSISSYLNWYQQKPGKAPKLLIY AASSLQSGVPSRFSGRGSGTDFTLTISSLQPEDFATYYCQQSYSTPF TFGPGTKVEIK |

TABLE 35-continued

Sequence table

| SEQ ID NO: | Designation | Format/ Source | Sequence |
|---|---|---|---|
| 1062 | CD70_30xCD 3-scFc | bispecific molecule | QVQLVESGGGVVQPGRSLRLSCAASGFMFSSYGMHWVRQAPGKGLEW VAVISYEGSNKYYAESVKGRFTISRDNSKNTLYLQMNSLRAEDTAVY YCARGRYYGSGNYNHGMDVWGQGTTVTVSSGGGGSGGGGSGGGGSDI QMTQSPSSLSASVGDRVTITCRASQSISSYLNWYQQKPGKAPKLLIY AASSLQSGVPSRFSGRGSGTDFTLTISSLQPEDFATYYCQQSYSTPF TFGPGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 1063 | CD70_30xCD 3-scFc | bispecific HLE molecule | QVQLVESGGGVVQPGRSLRLSCAASGFMFSSYGMHWVRQAPGKGLEW VAVISYEGSNKYYAESVKGRFTISRDNSKNTLYLQMNSLRAEDTAVY YCARGRYYGSGNYNHGMDVWGQGTTVTVSSGGGGSGGGGSGGGGSDI QMTQSPSSLSASVGDRVTITCRASQSISSYLNWYQQKPGKAPKLLIY AASSLQSGVPSRFSGRGSGTDFTLTISSLQPEDFATYYCQQSYSTPF TFGPGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 1064 | CD70_31_CC xCD3-scFc | VH CDR1 | SYGMH |
| 1065 | CD70_31_CC xCD3-scFc | VH CDR2 | VTWYDASNKYYGDAVKG |
| 1066 | CD70_31_CC xCD3-scFc | VH CDR3 | DLLRGVKGYAMDV |
| 1067 | CD70_31_CC xCD3-scFc | VL CDR1 | RASQSLRRIYLA |
| 1068 | CD70_31_CC xCD3-scFc | VL CDR2 | DVFDRAT |
| 1069 | CD70_31_CC xCD3-scFc | VL CDR3 | QQYSESPFT |
| 1070 | CD70_31_CC xCD3-scFc | VH | QVQLVESGGGVVQPGRSLRLSCAASGFTFSSYGMHWVRQAPGKCLEW VAVTWYDASNKYYGDAVKGRFTISRDNSKNTLYLQMNSLRAEDTAVY YCARDLLRGVKGYAMDVWGQGTTVTVSS |
| 1071 | CD70_31_CC xCD3-scFc | VL | EIVLTQSPGTLSLSPGERATLSCRASQSLRRIYLAWYQQKPGQAPRL LIYDVFDRATGIPDRFSGGGSGTDFTLTISRLEPEDFAVYYCQQYSE SPFTFGCGTKVDIK |
| 1072 | CD70_31_CC xCD3-scFc | scFv | QVQLVESGGGVVQPGRSLRLSCAASGFTFSSYGMHWVRQAPGKCLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGCGTKVDIK |
| 1073 | CD70_31_CC xCD3-scFc | bispecific molecule | QVQLVESGGGVVQPGRSLRLSCAASGFTFSSYGMHWVRQAPGKCLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGCGTKVDIKSGGGGSEVQLVESGGGLVQPGGSLKLSCAASGFTFNK YAMNWVRQAPGKGLEWVARIRSKYNNYATYYADSVKDRFTISRDDSK |

TABLE 35-continued

| Sequence table | | | |
|---|---|---|---|
| SEQ ID NO: | Designation | Format/ Source | Sequence |
| | | | NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVL |
| 1074 | CD70_31_CC xCD3-scFc | bispecific HLE molecule | QVQLVESGGGVVQPGRSLRLSCAASGFTFSSYGMHWVRQAPGKCLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGCGTKVDIKSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG K |
| 1075 | CD70_31xCD 3-scFc | VH | QVQLVESGGGVVQPGRSLRLSCAASGFTFSSYGMHWVRQAPGKGLEW VAVTWYDASNKYYGDAVKGRFTISRDNSKNTLYLQMNSLRAEDTAVY YCARDLLRGVKGYAMDVWGQGTTVTVSS |
| 1076 | CD70_31xCD 3-scFc | VL | EIVLTQSPGTLSLSPGERATLSCRASQSLRRIYLAWYQQKPGQAPRL LIYDVFDRATGIPDRFSGGGSGTDFTLTISRLEPEDFAVYYCQQYSE SPFTFGPGTKVDIK |
| 1077 | CD70_31xCD 3-scFc | scFv | QVQLVESGGGVVQPGRSLRLSCAASGFTFSSYGMHWVRQAPGKGLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGPGTKVDIK |
| 1078 | CD70_31xCD 3-scFc | bispecific molecule | QVQLVESGGGVVQPGRSLRLSCAASGFTFSSYGMHWVRQAPGKGLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGPGTKVDIKSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVL |
| 1079 | CD70_31xCD 3-scFc | bispecific HLE molecule | QVQLVESGGGVVQPGRSLRLSCAASGFTFSSYGMHWVRQAPGKGLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGPGTKVDIKSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGKGGGGSGGGGSGGGGSGGGGSG GGGSGGGGSDKTHTCPPCPAPELLGGPSVFLFPPKPKDTLMISRTPE VTCVVVDVSHEDPEVKFNWYVDGVEVHNAKTKPCEEQYGSTYRCVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD |

TABLE 35-continued

Sequence table

| SEQ ID NO: | Designation | Format/ Source | Sequence |
|---|---|---|---|
| | | | SDGSFFLYSKLTVDKSRWQQGNVFSCSVMHEALHNHYTQKSLSLSPGK |
| 1080 | CD70_32_CCxCD3-scFc | VH CDR1 | SYGIS |
| 1081 | CD70_32_CCxCD3-scFc | VH CDR2 | WISAYQGYTHYAQKLQG |
| 1082 | CD70_32_CCxCD3-scFc | VH CDR3 | DYGGNDYYGMDV |
| 1083 | CD70_32_CCxCD3-scFc | VL CDR1 | SGSSSNIGINYVY |
| 1084 | CD70_32_CCxCD3-scFc | VL CDR2 | RSDQRPS |
| 1085 | CD70_32_CCxCD3-scFc | VL CDR3 | AAFDESLSGVV |
| 1086 | CD70_32_CCxCD3-scFc | VH | QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSS |
| 1087 | CD70_32_CCxCD3-scFc | VL | QSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVL |
| 1088 | CD70_32_CCxCD3-scFc | scFv | QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVL |
| 1089 | CD70_32_CCxCD3-scFc | bispecific molecule | QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1090 | CD70_32_CCxCD3-scFc | bispecific HLE molecule | QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1091 | CD70_32xCD3-scFc | VH | QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSS |

TABLE 35-continued

Sequence table

| SEQ ID NO: | Designation | Format/ Source | Sequence |
|---|---|---|---|
| 1092 | CD70_32xCD 3-scFc | VL | QSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVL |
| 1093 | CD70_32xCD 3-scFc | scFv | QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVL |
| 1094 | CD70_32xCD 3-scFc | bispecific molecule | QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1095 | CD70_32xCD 3-scFc | bispecific HLE molecule | QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1096 | CD70_33_CC xCD3-scFc | VH CDR1 | YYGMH |
| 1097 | CD70_33_CC xCD3-scFc | VH CDR2 | VIWYDASNKYYADAVKG |
| 1098 | CD70_33_CC xCD3-scFc | VH CDR3 | DREMGSRGDFDY |
| 1099 | CD70_33_CC xCD3-scFc | VL CDR1 | RASQGINNYLA |
| 1100 | CD70_33_CC xCD3-scFc | VL CDR2 | AVSILQS |
| 1101 | CD70_33_CC xCD3-scFc | VL CDR3 | QQYNFYPFS |
| 1102 | CD70_33_CC xCD3-scFc | VH | QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSS |
| 1103 | CD70_33_CC xCD3-scFc | VL | DIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIK |
| 1104 | CD70_33_CC xCD3-scFc | scFv | QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMT |

TABLE 35-continued

Sequence table

| SEQ ID NO: | Designation | Format/ Source | Sequence |
|---|---|---|---|
| | | | QSPSSLSASVGDRVTITCRASQGINNYLAWFQQKPGKAPKSLIYAVS ILQSGVPSKFSGSGSGTDFTLTISNLQPEDFATYYCQQYNFYPFSFG CGTKVDIK |
| 1105 | CD70_33_CC xCD3-scFc | bispecific molecule | QAQLVESGGGVVQPGRSLRLSCAASGFTFSYYGMHWVRQAPGKCLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 1106 | CD70_33_CC xCD3-scFc | bispecific HLE molecule | QAQLVESGGGVVQPGRSLRLSCAASGFTFSYYGMHWVRQAPGKCLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 1107 | CD70_33xCD 3-scFc | VH | QAQLVESGGGVVQPGRSLRLSCAASGFTFSYYGMHWVRQAPGKGLEW VAVIWYDASNKYYADAVKGRFTISRDNSKNTLYLQMNSLRAEDTAVY YCARDREMGSRGDFDYWGQGTLVTVSS |
| 1108 | CD70_33xCD 3-scFc | VL | DIQMTQSPSSLSASVGDRVTITCRASQGINNYLAWFQQKPGKAPKSL IYAVSILQSGVPSKFSGSGSGTDFTLTISNLQPEDFATYYCQQYNFY PFSFGQGTKVDIK |
| 1109 | CD70_33xCD 3-scFc | scFv | QAQLVESGGGVVQPGRSLRLSCAASGFTFSYYGMHWVRQAPGKGLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG QGTKVDIK |
| 1110 | CD70_33xCD 3-scFc | bispecific molecule | QAQLVESGGGVVQPGRSLRLSCAASGFTFSYYGMHWVRQAPGKGLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG QGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 1111 | CD70_33xCD 3-scFc | bispecific HLE molecule | QAQLVESGGGVVQPGRSLRLSCAASGFTFSYYGMHWVRQAPGKGLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG QGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ |

TABLE 35-continued

| SEQ ID NO: | Designation | Format/ Source | Sequence |
|---|---|---|---|
| | | | PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 1112 | CD70_34_CC xCD3-scFc | VH CDR1 | GFYWS |
| 1113 | CD70_34_CC xCD3-scFc | VH CDR2 | EIYHSGHATNNPSLKS |
| 1114 | CD70_34_CC xCD3-scFc | VH CDR3 | GGNSGYIFDY |
| 1115 | CD70_34_CC xCD3-scFc | VL CDR1 | RTSQYIGRYLN |
| 1116 | CD70_34_CC xCD3-scFc | VL CDR2 | GASTLQQ |
| 1117 | CD70_34_CC xCD3-scFc | VL CDR3 | QQTYSTPRT |
| 1118 | CD70_34_CC xCD3-scFc | VH | QVQLQQWGAGLLKPSETLSLTCAVYGGSFSGFYWSWIRQPPGKCLEW IGEIYHSGHATNNPSLKSRVTISLDTSKNQFSLKLNSVTAADTAVYY CARGGNSGYIFDYWGQGTLVTVSS |
| 1119 | CD70_34_CC xCD3-scFc | VL | DVQMTQSPSSLSASVGDRVTITCRTSQYIGRYLNWYQQKPGKAPKVL IYGASTLQQGVPSRFSGSGSGTDFTLTITSLQPEDFASYYCQQTYST PRTFGCGTKVEIK |
| 1120 | CD70_34_CC xCD3-scFc | scFv | QVQLQQWGAGLLKPSETLSLTCAVYGGSFSGFYWSWIRQPPGKCLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGCGT KVEIK |
| 1121 | CD70_34_CC xCD3-scFc | bispecific molecule | QVQLQQWGAGLLKPSETLSLTCAVYGGSFSGFYWSWIRQPPGKCLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGCGT KVEIKSGGGGSEVQLVESGGGLVQPGGSLKLSCAASGFTFNKYAMNW VRQAPGKGLEWVARIRSKYNNYATYYADSVKDRFTISRDDSKNTAYL QMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNW VQQKPGQAPRGLIGGTKFLAPGTPARFSGSLLGGKAALTLSGVQPED EAEYYCVLWYSNRWVFGGGTKLTVL |
| 1122 | CD70_34_CC xCD3-scFc | bispecific HLE molecule | QVQLQQWGAGLLKPSETLSLTCAVYGGSFSGFYWSWIRQPPGKCLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGCGT KVEIKSGGGGSEVQLVESGGGLVQPGGSLKLSCAASGFTFNKYAMNW VRQAPGKGLEWVARIRSKYNNYATYYADSVKDRFTISRDDSKNTAYL QMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNW VQQKPGQAPRGLIGGTKFLAPGTPARFSGSLLGGKAALTLSGVQPED EAEYYCVLWYSNRWVFGGGTKLTVLGGGGDKTHTCPPCPAPELLGGP SVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAV EWESNGQPENNYKTTPPVLDSDGSFFLYSKLTVDKSRWQQGNVFSCS VMHEALHNHYTQKSLSLSPGKGGGGSGGGGSGGGGSGGGGSGGGGSG GGGSDKTHTCPPCPAPELLGGPSVFLFPPKPKDTLMISRTPEVTCVV VDVSHEDPEVKFNWYVDGVEVHNAKTKPCEEQYGSTYRCVSVLTVLH |

TABLE 35-continued

| SEQ ID NO: | Designation | Format/ Source | Sequence |
|---|---|---|---|
| Sequence table | | | |
| | | | QDWLNGKEYKCKVSNKALPAPIEKTISKAKGQPREPQVYTLPPSREE MTKNQVSLTCLVKGFYPSDIAVEWESNGQPENNYKTTPPVLDSDGSF FLYSKLTVDKSRWQQGNVFSCSVMHEALHNHYTQKSLSLSPGK |
| 1123 | CD70_34xCD 3-scFc | VH | QVQLQQWGAGLLKPSETLSLTCAVYGGSFSGFYWSWIRQPPGKGLEW IGEIYHSGHATNNPSLKSRVTISLDTSKNQFSLKLNSVTAADTAVYY CARGGNSGYIFDYWGQGTLVTVSS |
| 1124 | CD70_34xCD 3-scFc | VL | DVQMTQSPSSLSASVGDRVTITCRTSQYIGRYLNWYQQKPGKAPKVL IYGASTLQQGVPSRFSGSGSGTDFTLTITSLQPEDFASYYCQQTYST PRTFGQGTKVEIK |
| 1125 | CD70_34xCD 3-scFc | scFv | QVQLQQWGAGLLKPSETLSLTCAVYGGSFSGFYWSWIRQPPGKGLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGQGT KVEIK |
| 1126 | CD70_34xCD 3-scFc | bispecific molecule | QVQLQQWGAGLLKPSETLSLTCAVYGGSFSGFYWSWIRQPPGKGLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGQGT KVEIKSGGGGSEVQLVESGGGLVQPGGSLKLSCAASGFTFNKYAMNW VRQAPGKGLEWVARIRSKYNNYATYYADSVKDRFTISRDDSKNTAYL QMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNW VQQKPGQAPRGLIGGTKFLAPGTPARFSGSLLGGKAALTLSGVQPED EAEYYCVLWYSNRWVFGGGTKLTVL |
| 1127 | CD70_34xCD 3-scFc | bispecific HLE molecule | QVQLQQWGAGLLKPSETLSLTCAVYGGSFSGFYWSWIRQPPGKGLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGQGT KVEIKSGGGGSEVQLVESGGGLVQPGGSLKLSCAASGFTFNKYAMNW VRQAPGKGLEWVARIRSKYNNYATYYADSVKDRFTISRDDSKNTAYL QMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNW VQQKPGQAPRGLIGGTKFLAPGTPARFSGSLLGGKAALTLSGVQPED EAEYYCVLWYSNRWVFGGGTKLTVLGGGGDKTHTCPPCPAPELLGGP SVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAV EWESNGQPENNYKTTPPVLDSDGSFFLYSKLTVDKSRWQQGNVFSCS VMHEALHNHYTQKSLSLSPGKGGGGSGGGGSGGGGSGGGGSGGGGSG GGGSDKTHTCPPCPAPELLGGPSVFLFPPKPKDTLMISRTPEVTCVV VDVSHEDPEVKFNWYVDGVEVHNAKTKPCEEQYGSTYRCVSVLTVLH QDWLNGKEYKCKVSNKALPAPIEKTISKAKGQPREPQVYTLPPSREE MTKNQVSLTCLVKGFYPSDIAVEWESNGQPENNYKTTPPVLDSDGSF FLYSKLTVDKSRWQQGNVFSCSVMHEALHNHYTQKSLSLSPGK |
| 1128 | CD70_35_CC xCD3-scFc | VH CDR1 | TYGMH |
| 1129 | CD70_35_CC xCD3-scFc | VH CDR2 | VIWYEGSNKYYGESVKG |
| 1130 | CD70_35_CC xCD3-scFc | VH CDR3 | DNSHYYYGMDV |
| 1131 | CD70_35_CC xCD3-scFc | VL CDR1 | TGSSSNIGAGYDVN |
| 1132 | CD70_35_CC xCD3-scFc | VL CDR2 | VNNNRPS |
| 1133 | CD70_35_CC xCD3-scFc | VL CDR3 | QSYDTSLSASV |
| 1134 | CD70_35_CC xCD3-scFc | VH | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTTVTVSS |

TABLE 35-continued

| SEQ ID NO: | Designation | Format/ Source | Sequence |
|---|---|---|---|
| | | | Sequence table |
| 1135 | CD70_35_CC xCD3-scFc | VL | QSVLTQPPSVSGAPGQRVTISCTGSSSNIGAGYDVNWYQQFPGTAPK LLIYVNNNRPSGVPDRFSGSTSGTSASLAITGLQAEDEADYYCQSYD TSLSASVFGCGTRLTVL |
| 1136 | CD70_35_CC xCD3-scFc | scFv | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGCGTRLTVL |
| 1137 | CD70_35_CC xCD3-scFc | bispecific molecule | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGCGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 1138 | CD70_35_CC xCD3-scFc | bispecific HLE molecule | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGCGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 1139 | CD70_35xCD 3-scFc | VH | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTTVTVSS |
| 1140 | CD70_35xCD 3-scFc | VL | QSVLTQPPSVSGAPGQRVTISCTGSSSNIGAGYDVNWYQQFPGTAPK LLIYVNNNRPSGVPDRFSGSTSGTSASLAITGLQAEDEADYYCQSYD TSLSASVFGGGTRLTVL |
| 1141 | CD70_35xCD 3-scFc | scFv | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGGGTRLTVL |
| 1142 | CD70_35xCD 3-scFc | bispecific molecule | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGGGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |

TABLE 35-continued

Sequence table

| SEQ ID NO: | Designation | Format/ Source | Sequence |
|---|---|---|---|
| 1143 | CD70_35xCD 3-scFc | bispecific HLE molecule | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGGGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 1144 | CD70_36_CC xCD3-scFc | VH CDR1 | TYGMH |
| 1145 | CD70_36_CC xCD3-scFc | VH CDR2 | VIWYEGSNKYYGESVKG |
| 1146 | CD70_36_CC xCD3-scFc | VH CDR3 | DNSHYYYGMDV |
| 1147 | CD70_36_CC xCD3-scFc | VL CDR1 | TGSSSNIGAGYDVN |
| 1148 | CD70_36_CC xCD3-scFc | VL CDR2 | VNNNRPS |
| 1149 | CD70_36_CC xCD3-scFc | VL CDR3 | QSYETSLSASV |
| 1150 | CD70_36_CC xCD3-scFc | VH | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTLVTVSS |
| 1151 | CD70_36_CC xCD3-scFc | VL | QSVLTQPPSVSGAPGQRVTISCTGSSSNIGAGYDVNWYQQLPGTAPK LLIYVNNNRPSGVPDRFSGSKSGTSASLAITGLQAEDEADYYCQSYE TSLSASVFGCGTRLTVL |
| 1152 | CD70_36_CC xCD3-scFc | scFv | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGCGTRLTVL |
| 1153 | CD70_36_CC xCD3-scFc | bispecific molecule | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGCGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 1154 | CD70_36_CC xCD3-scFc | bispecific HLE molecule | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGCGTRLTVLSGGGGSEVQLVESGGGLVQPGGSLKLSCAASGFTFN |

TABLE 35-continued

| Sequence table | | | |
|---|---|---|---|
| SEQ ID NO: | Designation | Format/ Source | Sequence |
| | | | KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 1155 | CD70_36xCD 3-scFc | VH | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTLVTVSS |
| 1156 | CD70_36xCD 3-scFc | VL | QSVLTQPPSVSGAPGQRVTISCTGSSSNIGAGYDVNWYQQLPGTAPK LLIYVNNNRPSGVPDRFSGSKSGTSASLAITGLQAEDEADYYCQSYE TSLSASVFGGGTRLTVL |
| 1157 | CD70_36xCD 3-scFc | scFv | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGGGTRLTVL |
| 1158 | CD70_36xCD 3-scFc | bispecific molecule | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGGGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 1159 | CD70_36xCD 3-scFc | bispecific HLE molecule | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGGGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGKGGGGSGGGGSGGGGSGGGGS GGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVS VLTVLHQDWLNGKEYKCKVSNKALPAPIEKTISKAKGQPREPQVYTL PPSREEMTKNQVSLTCLVKGFYPSDIAVEWESNGQPENNYKTTPPVL DSDGSFFLYSKLTVDKSRWQQGNVFSCSVMHEALHNHYTQKSLSLSP GK |
| 1160 | CD70_37_CC xCD3-scFc | VH CDR1 | SGVYYWS |
| 1161 | CD70_37_CC xCD3-scFc | VH CDR2 | YIYYSGSTSYNPSLKS |
| 1162 | CD70_37_CC xCD3-scFc | VH CDR3 | SGYSYALFDY |

TABLE 35-continued

| Sequence table | | | |
|---|---|---|---|
| SEQ ID NO: | Designation | Format/ Source | Sequence |
| 1163 | CD70_37_CC xCD3-scFc | VL CDR1 | RASQSVDRYFN |
| 1164 | CD70_37_CC xCD3-scFc | VL CDR2 | AASSLQS |
| 1165 | CD70_37_CC xCD3-scFc | VL CDR3 | QQSYSTPWT |
| 1166 | CD70_37_CC xCD3-scFc | VH | QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSS |
| 1167 | CD70_37_CC xCD3-scFc | VL | DIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVK |
| 1168 | CD70_37_CC xCD3-scFc | scFv | QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVK |
| 1169 | CD70_37_CC xCD3-scFc | bispecific molecule | QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1170 | CD70_37_CC xCD3-scFc | bispecific HLE molecule | QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1171 | CD70_37xCD 3-scFc | VH | QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSS |
| 1172 | CD70_37xCD 3-scFc | VL | DIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVK |
| 1173 | CD70_37xCD 3-scFc | scFv | QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVK |

TABLE 35-continued

| Sequence table | | | |
|---|---|---|---|
| SEQ ID NO: | Designation | Format/ Source | Sequence |
| 1174 | CD70_37xCD 3-scFc | bispecific molecule | QMQLQESGPGLVKPSETLSLTCTVSGGSIESGVYYWSWIRQPPGKGL EWIGYIYYSGSTSYNPSLKSRLTMSVDTSKNQFSLKLSSVTAADTAV YYCARSGYSYALFDYWGQGTLVTVSSGGGGSGGGGSGGGGSDIQMTQ SPSSLSASLGDRVTITCRASQSVDRYFNWYQQKPGKAPKVLIFAASS LQSGVPSRFSGSGSGTDFTLTISSLQPEDFATYYCQQSYSTPWTFGQ GTKVEVKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVL |
| 1175 | CD70_37xCD 3-scFc | bispecific HLE molecule | QMQLQESGPGLVKPSETLSLTCTVSGGSIESGVYYWSWIRQPPGKGL EWIGYIYYSGSTSYNPSLKSRLTMSVDTSKNQFSLKLSSVTAADTAV YYCARSGYSYALFDYWGQGTLVTVSSGGGGSGGGGSGGGGSDIQMTQ SPSSLSASLGDRVTITCRASQSVDRYFNWYQQKPGKAPKVLIFAASS LQSGVPSRFSGSGSGTDFTLTISSLQPEDFATYYCQQSYSTPWTFGQ GTKVEVKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGKGGGGSGGGGSGGGGSGGGGSGGGG SGGGGSDKTHTCPPCPAPELLGGPSVFLFPPKPKDTLMISRTPEVTC VVVDVSHEDPEVKFNWYVDGVEVHNAKTKPCEEQYGSTYRCVSVLTV LHQDWLNGKEYKCKVSNKALPAPIEKTISKAKGQPREPQVYTLPPSR EEMTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 1176 | CD70_38_CC xCD3-scFc | VH CDR1 | SGGYYWS |
| 1177 | CD70_38_CC xCD3-scFc | VH CDR2 | YIFYSGSTDYNPSLKS |
| 1178 | CD70_38_CC xCD3-scFc | VH CDR3 | SGYSYALFDA |
| 1179 | CD70_38_CC xCD3-scFc | VL CDR1 | RASQFIGRYFN |
| 1180 | CD70_38_CC xCD3-scFc | VL CDR2 | AESSLQS |
| 1181 | CD70_38_CC xCD3-scFc | VL CDR3 | QQSYSTPWT |
| 1182 | CD70_38_CC xCD3-scFc | VH | QVQLQESGPGLVKPSQTLSLTCTVSGDSIISGGYYWSWIRQPPGKCL EWIGYIFYSGSTDYNPSLKSRVTISVDTSKNQFSLKLSSVTAADTAV YYCARSGYSYALFDAWGQGTLVTVSS |
| 1183 | CD70_38_CC xCD3-scFc | VL | DIQMTQSPSSLSASVGDRVTISCRASQFIGRYFNWYQQKPGKAPKVL IYAESSLQSGVPSRFSGSGSGTEFTLTISSLQPEDFATYYCQQSYST PWTFGCGTKVEIK |
| 1184 | CD70_38_CC xCD3-scFc | scFv | QVQLQESGPGLVKPSQTLSLTCTVSGDSIISGGYYWSWIRQPPGKCL EWIGYIFYSGSTDYNPSLKSRVTISVDTSKNQFSLKLSSVTAADTAV YYCARSGYSYALFDAWGQGTLVTVSSGGGGSGGGGSGGGGSDIQMTQ SPSSLSASVGDRVTISCRASQFIGRYFNWYQQKPGKAPKVLIYAESS LQSGVPSRFSGSGSGTEFTLTISSLQPEDFATYYCQQSYSTPWTFGC GTKVEIK |
| 1185 | CD70_38_CC xCD3-scFc | bispecific molecule | QVQLQESGPGLVKPSQTLSLTCTVSGDSIISGGYYWSWIRQPPGKCL EWIGYIFYSGSTDYNPSLKSRVTISVDTSKNQFSLKLSSVTAADTAV YYCARSGYSYALFDAWGQGTLVTVSSGGGGSGGGGSGGGGSDIQMTQ SPSSLSASVGDRVTISCRASQFIGRYFNWYQQKPGKAPKVLIYAESS LQSGVPSRFSGSGSGTEFTLTISSLQPEDFATYYCQQSYSTPWTFGC GTKVEIKSGGGGSEVQLVESGGGLVQPGGSLKLSCAASGFTFNKYAM NWVRQAPGKGLEWVARIRSKYNNYATYYADSVKDRFTISRDDSKNTA |

TABLE 35-continued

| Sequence table | | | |
|---|---|---|---|
| SEQ ID NO: | Designation | Format/ Source | Sequence |
| | | | YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVL |
| 1186 | CD70_38_CC xCD3-scFc | bispecific HLE molecule | QVQLQESGPGLVKPSQTLSLTCTVSGDSIISGGYYWSWIRQPPGKCL<br>EWIGYIFYSGSTDYNPSLKSRVTISVDTSKNQFSLKLSSVTAADTAV<br>YYCARSGYSYALFDAWGQGTLVTVSSGGGGSGGGGSGGGGSDIQMTQ<br>SPSSLSASVGDRVTISCRASQFIGRYFNWYQQKPGKAPKVLIYAESS<br>LQSGVPSRFSGSGSGTEFTLTISSLQPEDFATYYCQQSYSTPWTFGC<br>GTKVEIKSGGGGSEVQLVESGGGLVQPGGSLKLSCAASGFTFNKYAM<br>NWVRQAPGKGLEWVARIRSKYNNYATYYADSVKDRFTISRDDSKNTA<br>YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVLGGGGDKTHTCPPCPAPELLG<br>GPSVFLFPPKPKDTLMISRTPEVTCVVVDVSHEDPEVKFNWYVDGVE<br>VHNAKTKPCEEQYGSTYRCVSVLTVLHQDWLNGKEYKCKVSNKALPA<br>PIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFS<br>CSVMHEALHNHYTQKSLSLSPGKGGGGSGGGGSGGGGSGGGGSGGGG<br>SGGGGSDKTHTCPPCPAPELLGGPSVFLFPPKPKDTLMISRTPEVTC<br>VVVDVSHEDPEVKFNWYVDGVEVHNAKTKPCEEQYGSTYRCVSVLTV<br>LHQDWLNGKEYKCKVSNKALPAPIEKTISKAKGQPREPQVYTLPPSR<br>EEMTKNQVSLTCLVKGFYPSDIAVEWESNGQPENNYKTTPPVLDSDG<br>SFFLYSKLTVDKSRWQQGNVFSCSVMHEALHNHYTQKSLSLSPGK |
| 1187 | CD70_38xCD 3-scFc | VH | QVQLQESGPGLVKPSQTLSLTCTVSGDSIISGGYYWSWIRQPPGKGL<br>EWIGYIFYSGSTDYNPSLKSRVTISVDTSKNQFSLKLSSVTAADTAV<br>YYCARSGYSYALFDAWGQGTLVTVSS |
| 1188 | CD70_38xCD 3-scFc | VL | DIQMTQSPSSLSASVGDRVTISCRASQFIGRYFNWYQQKPGKAPKVL<br>IYAESSLQSGVPSRFSGSGSGTEFTLTISSLQPEDFATYYCQQSYST<br>PWTFGQGTKVEIK |
| 1189 | CD70_38xCD 3-scFc | scFv | QVQLQESGPGLVKPSQTLSLTCTVSGDSIISGGYYWSWIRQPPGKGL<br>EWIGYIFYSGSTDYNPSLKSRVTISVDTSKNQFSLKLSSVTAADTAV<br>YYCARSGYSYALFDAWGQGTLVTVSSGGGGSGGGGSGGGGSDIQMTQ<br>SPSSLSASVGDRVTISCRASQFIGRYFNWYQQKPGKAPKVLIYAESS<br>LQSGVPSRFSGSGSGTEFTLTISSLQPEDFATYYCQQSYSTPWTFGQ<br>GTKVEIK |
| 1190 | CD70_38xCD 3-scFc | bispecific molecule | QVQLQESGPGLVKPSQTLSLTCTVSGDSIISGGYYWSWIRQPPGKGL<br>EWIGYIFYSGSTDYNPSLKSRVTISVDTSKNQFSLKLSSVTAADTAV<br>YYCARSGYSYALFDAWGQGTLVTVSSGGGGSGGGGSGGGGSDIQMTQ<br>SPSSLSASVGDRVTISCRASQFIGRYFNWYQQKPGKAPKVLIYAESS<br>LQSGVPSRFSGSGSGTEFTLTISSLQPEDFATYYCQQSYSTPWTFGQ<br>GTKVEIKSGGGGSEVQLVESGGGLVQPGGSLKLSCAASGFTFNKYAM<br>NWVRQAPGKGLEWVARIRSKYNNYATYYADSVKDRFTISRDDSKNTA<br>YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVL |
| 1191 | CD70_38xCD 3-scFc | bispecific HLE molecule | QVQLQESGPGLVKPSQTLSLTCTVSGDSIISGGYYWSWIRQPPGKGL<br>EWIGYIFYSGSTDYNPSLKSRVTISVDTSKNQFSLKLSSVTAADTAV<br>YYCARSGYSYALFDAWGQGTLVTVSSGGGGSGGGGSGGGGSDIQMTQ<br>SPSSLSASVGDRVTISCRASQFIGRYFNWYQQKPGKAPKVLIYAESS<br>LQSGVPSRFSGSGSGTEFTLTISSLQPEDFATYYCQQSYSTPWTFGQ<br>GTKVEIKSGGGGSEVQLVESGGGLVQPGGSLKLSCAASGFTFNKYAM<br>NWVRQAPGKGLEWVARIRSKYNNYATYYADSVKDRFTISRDDSKNTA<br>YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVLGGGGDKTHTCPPCPAPELLG<br>GPSVFLFPPKPKDTLMISRTPEVTCVVVDVSHEDPEVKFNWYVDGVE<br>VHNAKTKPCEEQYGSTYRCVSVLTVLHQDWLNGKEYKCKVSNKALPA<br>PIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFS<br>CSVMHEALHNHYTQKSLSLSPGKGGGGSGGGGSGGGGSGGGGSGGGG<br>SGGGGSDKTHTCPPCPAPELLGGPSVFLFPPKPKDTLMISRTPEVTC<br>VVVDVSHEDPEVKFNWYVDGVEVHNAKTKPCEEQYGSTYRCVSVLTV<br>LHQDWLNGKEYKCKVSNKALPAPIEKTISKAKGQPREPQVYTLPPSR<br>EEMTKNQVSLTCLVKGFYPSDIAVEWESNGQPENNYKTTPPVLDSDG<br>SFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| Sequence table | | | |
| 1192 | CD70_1_CCx CD3-scFc_delGK | bispecific HLE molecule | EVQLLESGGGLVQPGGSLRLSCAASGFTFSSYAMSWVRQAPGKCLEW<br>VSVISGSGGRPNYAESVKGRFTISRDNSKNTLYLQMNSLRDEDTAVY<br>YCAKVDYSNYLFFDYWGQGTLVTVSSGGGGSGGGGSGGGGSEIVLTQ<br>SPGTLSLSPGEGATLSCRAGQSVRSSYLGWYQQKPGQAPRLLIYGAS<br>SRATGIPDRFSGSGSGTDFTLTISRLEPEDFAVYYCQQYGYSPPTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 1193 | CD70_1xCD3 -scFc_delGK | bispecific HLE molecule | EVQLLESGGGLVQPGGSLRLSCAASGFTFSSYAMSWVRQAPGKGLEW<br>VSVISGSGGRPNYAESVKGRFTISRDNSKNTLYLQMNSLRDEDTAVY<br>YCAKVDYSNYLFFDYWGQGTLVTVSSGGGGSGGGGSGGGGSEIVLTQ<br>SPGTLSLSPGEGATLSCRAGQSVRSSYLGWYQQKPGQAPRLLIYGAS<br>SRATGIPDRFSGSGSGTDFTLTISRLEPEDFAVYYCQQYGYSPPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 1194 | CD70_2_CCx CD3-scFc_delGK | bispecific HLE molecule | EVQLLESGGGLVQPGGSLKLSCAASGFTFSIYAMSWVRQAPGKCLEW<br>VSAISGSGGSTFYAESVKGRFTISRDNSKNTLYLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSSYLAWYQQKPGQAPRLLIYGAS<br>SRATGIPDRFSGSGSGTDFTLTISRLEPEDFAVYYCQQYGDLPFTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 1195 | CD70_2xCD3 -scFc_delGK | bispecific HLE molecule | EVQLLESGGGLVQPGGSLKLSCAASGFTFSIYAMSWVRQAPGKGLEW<br>VSAISGSGGSTFYAESVKGRFTISRDNSKNTLYLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSSYLAWYQQKPGQAPRLLIYGAS<br>SRATGIPDRFSGSGSGTDFTLTISRLEPEDFAVYYCQQYGDLPFTFG<br>PGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG |

TABLE 35-continued

Sequence table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1196 | CD70 3 CCx CD3-scFc_delGK | bispecific HLE molecule | EVQLLESGGGMVQPGGSLRLSCAASGFTFSSYAMSWVRQAPGKCLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1197 | CD70_3xCD3-scFc_delGK | bispecific HLE molecule | EVQLLESGGGMVQPGGSLRLSCAASGFTFSSYAMSWVRQAPGKGLEW VSAISGSGGRTFYAESVEGRFTISRDNSKNTLFLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1198 | CD70_4_CCx CD3-scFc_delGK | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSSYLAWYQQKPGQAPRLLIYGAS SRATGIPDRFSGSGSGTDFTLTISRLEPEDFAVYYCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV |

TABLE 35-continued

| Sequence table | | | |
|---|---|---|---|
| SEQ ID NO: | Designation | Format/ Source | Sequence |
| | | | VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1199 | CD70_4xCD3 -scFc_delGK | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSSYLAWYQQKPGQAPRLLIYGAS SRATGIPDRFSGSGSGTDFTLTISRLEPEDFAVYYCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1200 | CD70_5_CCx CD3- scFc_delGK | bispecific HLE molecule | EVQLLESGGGLVQSGGSLRLSCAASGFTFSSYAMSWVRQAPGKCLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1201 | CD70_5xCD3 -scFc_delGK | bispecific HLE molecule | EVQLLESGGGLVQSGGSLRLSCAASGFTFSSYAMSWVRQAPGKGLEW VSAISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1202 | CD70_6_CCx CD3- scFc_delGK | bispecific HLE molecule | EVQLLESGGGLVQPGGSLRLSCAASGFTFSSYAMSWVRQAPGKCLEW VSLISGSGGRTHYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYDAS |

TABLE 35-continued

Sequence table

| SEQ ID NO: | Designation | Format/ Source | Sequence |
|---|---|---|---|
| | | | SRATGIPDRFSGSGSGTDFTLTISRLEPEDFAVYFCQQYGSSPPTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 1203 | CD70_6xCD3<br>-scFc_delGK | bispecific<br>HLE<br>molecule | EVQLLESGGGLVQPGGSLRLSCAASGFTFSSYAMSWVRQAPGKGLEW<br>VSLISGSGGRTHYAESVKGRFTISRDNSKNTLYLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSTYLAWYQQKPGQAPRLLIYDAS<br>SRATGIPDRFSGSGSGTDFTLTISRLEPEDFAVYFCQQYGSSPPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 1204 | CD70_7_CCx<br>CD3-<br>scFc_delGK | bispecific<br>HLE<br>molecule | EVQLLESGGGLVQPGGSLRLSCAASGFTFSTYAMSWVRQAPGKCLEW<br>VSAISGSGGSTFYAESVKGRFTISRDNSKNTLSLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSSYLAWYQQKPGQAPRLLIYGAS<br>SRATGIPDRFSGSGSGTDFTLTISRLEPEDFAVYYCQQYGDLPFTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 1205 | CD70_7xCD3<br>-scFc_delGK | bispecific<br>HLE<br>molecule | EVQLLESGGGLVQPGGSLRLSCAASGFTFSTYAMSWVRQAPGKGLEW<br>VSAISGSGGSTFYAESVKGRFTISRDNSKNTLSLQMNSLRAEDTAVY<br>YCAKHDYSNYPYFDYWGQGTLVTVSSGGGGSGGGGSGGGGSEIVLTQ<br>SPGTLSLSPGERATLSCRASQSVRSSYLAWYQQKPGQAPRLLIYGAS<br>SRATGIPDRFSGSGSGTDFTLTISRLEPEDFAVYYCQQYGDLPFTFG<br>PGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP |

TABLE 35-continued

| Sequence table | | | |
|---|---|---|---|
| SEQ ID NO: | Designation | Format/ Source | Sequence |
| | | | APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1206 | CD70_8_CCx CD3-scFc_delGK | bispecific HLE molecule | EVQLLESGGGMVQPGGSLRLSCAASGFTFSTYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1207 | CD70_8xCD3-scFc_delGK | bispecific HLE molecule | EVQLLESGGGMVQPGGSLRLSCAASGFTFSTYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSTYLAWYQQKPGQAPRLLIYGAS SRATGIPDRFSGSGSGTDFTLTISRLEPEDFAVYSCQQYGDLPFTFG PGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1208 | CD70_9_CCx CD3-scFc_delGK | bispecific HLE molecule | EVQLLESGGGLVQPGGSLRLSCAASGFTFSSYAMSWVRQAPGKCLEW VSAISGSGGYTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |

TABLE 35-continued

| Sequence table | | | |
|---|---|---|---|
| SEQ ID NO: | Designation | Format/ Source | Sequence |
| 1209 | CD70_9xCD3 -scFc_delGK | bispecific HLE molecule | EVQLLESGGGLVQPGGSLRLSCAASGFTFSSYAMSWVRQAPGKGLEW VSAISGSGGYTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1210 | CD70_10_CC xCD3- scFc_delGK | bispecific HLE molecule | EVQLLESGGGLAQPGGSLRLSCAASGFTFSSYAMSWVRQAPGKCLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1211 | CD70_10xCD 3-scFc_delGK | bispecific HLE molecule | EVQLLESGGGLAQPGGSLRLSCAASGFTFSSYAMSWVRQAPGKGLEW VSAISGSGGSTFYAESVKGRFTISRDNSKNTLYLQMNSLRAEDTAVY FCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1212 | CD70_11_CC xCD3- scFc_delGK | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY |

TABLE 35-continued

Sequence table

| SEQ ID NO: | Designation | Format/ Source | Sequence |
|---|---|---|---|
| | | | PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1213 | CD70_11xCD 3-scFc_delGK | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTISRLEPEDFAVYYCQQYGDLPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1214 | CD70_12_CC xCD3- scFc_delGK | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1215 | CD70_12xCD 3-scFc_delGK | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGSSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL |

TABLE 35-continued

| SEQ ID NO: | Designation | Format/ Source | Sequence |
|---|---|---|---|
| | | | HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1216 | CD70_13_CC xCD3- scFc_delGK | bispecific HLE molecule | EVQLLESGGGLVQPGGSLRLSCAASGFTFSSYAMSWVRQAPGKCLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1217 | CD70_13xCD 3-scFc_delGK | bispecific HLE molecule | EVQLLESGGGLVQPGGSLRLSCAASGFTFSSYAMSWVRQAPGKGLEW VSAISGSGGSTFYAESVQGRFTISRDNSKNTLYLQVNSLRAEDTAVY YCARHDYSNYPYFDYWGQGTLVTVSSGGGGSGGGGSGGGGSEIVLTQ SPGTLSLSPGERATLSCRASQSVRGNYLAWYQQKPGQAPRLLIYGAS SRATGIPDRFSGSGSGTDFTLTISRLEPEDFAVYYCQQYGYSPFTFG PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1218 | CD70_14_CC xCD3- scFc_delGK | bispecific HLE molecule | EVQLLESGGGLVQPGGSLRLSCAASGFTFSTYAMSWVRQAPGKCLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1219 | CD70_14xCD 3-scFc_delGK | bispecific HLE molecule | EVQLLESGGGLVQPGGSLRLSCAASGFTFSTYAMSWVRQAPGKGLEW VSAISGSGGGTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPFTFG |

TABLE 35-continued

| Sequence table | | | |
|---|---|---|---|
| SEQ ID NO: | Designation | Format/ Source | Sequence |
| | | | PGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1220 | CD70_15_CC xCD3- scFc_delGK | bispecific HLE molecule | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1221 | CD70_15xCD 3-scFc_delGK | bispecific HLE molecule | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS NRATGIPDRFSGSGSGTDFTLTISRLEPEDFAVYSCQQYGISPPTFG GGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1222 | CD70_16_CC xCD3- scFc_delGK | bispecific HLE molecule | EVQLLESGGGLVQPGGSLRLSCAASGFTFSSYAMSWVRQSPGKCLEW VSAISGSGGRAQYAESVQGRFTVSRDNSKNTLYLQMNSLRAEDTAVY YCAKHDYSNYPYFDYWGQGTLVTVSSGGGGSGGGGSGGGGSEIVLTQ SPATLSVSPGERATLSCRASQSVSSNLAWYQQKPGQAPRLLIYGSSS RATGIPDRFSGSGSGTDFTLTISRLEPEDFAVYYCQQYGSSPPPFGC GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI |

TABLE 35-continued

| Sequence table | | | |
|---|---|---|---|
| SEQ ID NO: | Designation | Format/ Source | Sequence |
| | | | AVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1223 | CD70_16xCD3-scFc_delGK | bispecific HLE molecule | EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1224 | CD70_17_CCxCD3-scFc_delGK | bispecific HLE molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1225 | CD70_17xCD3-scFc_delGK | bispecific HLE molecule | EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| Sequence table | | | |
| 1226 | CD70_18_CC xCD3- scFc_delGK | bispecific HLE molecule | EVQLLESGGGLVQPGGSLRLSCAASGFTFSSYAMSWVRQAPGKCLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1227 | CD70_18xCD 3-scFc_delGK | bispecific HLE molecule | EVQLLESGGGLVQPGGSLRLSCAASGFTFSSYAMSWVRQAPGKGLEW VSAIGEGGGYTYYAESVKGRFTISRDNSKNTLSLLMNSLRAEDTAVY YCARHDYSNYPYFDYWGQGTLVTVSSGGGGSGGGGSGGGGSEIVLTQ SPGTLSLSPGERATLSCRASQGVRSSYFAWYQQKPGQAPRLLIYGAS TRATGIPARFSGSGSGTDFTLTISRLEPEDFAVYYCQQYGSSPPTFG QGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1228 | CD70_19_CC xCD3- scFc_delGK | bispecific HLE molecule | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG CGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1229 | CD70_19xCD 3-scFc_delGK | bispecific HLE molecule | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSIRSNYLAWYQQKPGQAPRLLIYGAS SRATGIPDRFSGSGSGTDFTLTISRLEPEDFAVYYCQQYGSSPPSFG QGTKVEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 35-continued

| Sequence table | | | |
|---|---|---|---|
| SEQ ID NO: | Designation | Format/ Source | Sequence |
| | | | GGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1230 | CD70_20_CCxCD3-scFc_delGK | bispecific HLE molecule | EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1231 | CD70_20xCD3-scFc_delGK | bispecific HLE molecule | EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1232 | CD70_21_CCxCD3-scFc_delGK | bispecific HLE molecule | EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCV |

TABLE 35-continued

| SEQ ID NO: | Designation | Format/ Source | Sequence |
|---|---|---|---|
| | | | Sequence table |
| | | | VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1233 | CD70_21xCD 3-scFc_delGK | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCTKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYYCQQYGDLPFTFG PGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1234 | CD70_22_CC xCD3- scFc_delGK | bispecific HLE molecule | EVQLLESGGGLVQPGGSLRLSCAASGFTFSTYAMSWVRQAPGKCLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1235 | CD70_22xCD 3-scFc_delGK | bispecific HLE molecule | EVQLLESGGGLVQPGGSLRLSCAASGFTFSTYAMSWVRQAPGKGLEW VSLISGSGGRTYYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQGVRSSYLAWYQQKPGQAPRLLIYGAS SRATGIPDRFSGSGSGTDFTLTINRLEPEDFAVYYCQQYGSSPPTFG GGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1236 | CD70_23_CC xCD3- scFc_delGK | bispecific HLE molecule | EVQLLESGGGVVQPGRSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS |

TABLE 35-continued

| Sequence table | | | |
|---|---|---|---|
| SEQ ID NO: | Designation | Format/ Source | Sequence |
| | | | SRATGIPDRFSGSGSGTDFTLTINRLEPEDFAVYYCQQYGSSPPTFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1237 | CD70_23xCD 3-scFc_delGK | bispecific HLE molecule | EVQLLESGGGVVQPGRSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSNYLAWYQQKPGQAPRLLIYGAS SRATGIPDRFSGSGSGTDFTLTINRLEPEDFAVYYCQQYGSSPPTFG GGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1238 | CD70_24_CC xCD3- scFc_delGK | bispecific HLE molecule | EVQLLESGGGLVQPGGSLRLSCAASGFTFSSYAMSWVRQAPGKCLEW VSVISGSGGITDFAESVKGRFTISRDNSRNTLYLQMNSLRAEDTAVY FCARHDYSNYFFFDYWGQGTLVTVSSGGGGSGGGGSGGGGSDIQMTQ SPSSLSASVGDRVTITCRASQGISNYLAWYQQKPGKVPKLLIYAASI LQSGVPSKFSGSGSGTDFTLTISSLQPEDFAIYYCQQYFAYPITFGC GTRLEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGGGGSGGGGSGGGGSGGGGSGGGGSG GGGSDKTHTCPPCPAPELLGGPSVFLFPPKPKDTLMISRTPEVTCVV VDVSHEDPEVKFNWYVDGVEVHNAKTKPCEEQYGSTYRCVSVLTVLH QDWLNGKEYKCKVSNKALPAPIEKTISKAKGQPREPQVYTLPPSREE MTKNQVSLTCLVKGFYPSDIAVEWESNGQPENNYKTTPPVLDSDGSF FLYSKLTVDKSRWQQGNVFSCSVMHEALHNHYTQKSLSLSPGK |
| 1239 | CD70_24xCD 3-scFc_delGK | bispecific HLE molecule | EVQLLESGGGLVQPGGSLRLSCAASGFTFSSYAMSWVRQAPGKGLEW VSVISGSGGITDFAESVKGRFTISRDNSRNTLYLQMNSLRAEDTAVY FCARHDYSNYFFFDYWGQGTLVTVSSGGGGSGGGGSGGGGSDIQMTQ SPSSLSASVGDRVTITCRASQGISNYLAWYQQKPGKVPKLLIYAASI LQSGVPSKFSGSGSGTDFTLTISSLQPEDFAIYYCQQYFAYPITFGQ GTRLEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA |

TABLE 35-continued

| SEQ ID NO: | Designation | Format/ Source | Sequence |
|---|---|---|---|
| | | | PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGGGGSGGGGSGGGGSGGGGSGGGGSG GGGSDKTHTCPPCPAPELLGGPSVFLFPPKPKDTLMISRTPEVTCVV VDVSHEDPEVKFNWYVDGVEVHNAKTKPCEEQYGSTYRCVSVLTVLH QDWLNGKEYKCKVSNKALPAPIEKTISKAKGQPREPQVYTLPPSREE MTKNQVSLTCLVKGFYPSDIAVEWESNGQPENNYKTTPPVLDSDGSF FLYSKLTVDKSRWQQGNVFSCSVMHEALHNHYTQKSLSLSPGK |
| 1240 | CD70_25_CC xCD3- scFc_delGK | bispecific HLE molecule | EVQLLESGGGMVQPGGSLRLSCAASGFTFSSYAMSWVRQAPGKCLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG CGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1241 | CD70_25xCD 3-scFc_delGK | bispecific HLE molecule | EVQLLESGGGMVQPGGSLRLSCAASGFTFSSYAMSWVRQAPGKGLEW VSAISGSGGRTFYAESVEGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYLAWYQQKPGQAPRLLIYGAS SRATGIPDRFSGSGSGTDFTLTISRLEPEDFAVYFCQQYGSSPPTFG GGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1242 | CD70_26_CC xCD3- scFc_delGK | bispecific HLE molecule | EVQLLESGGGLVQPGGSLRLSCAASGFTFSIYAMSWVRQAPGKCLEW VSAIGGSGGSTFYAESVKGRFTISRDNSKNTLYLQMNSLRAEDTAVY YCAKHDYSNYPYFDYWGQGTLVTVSSGGGGSGGGGSGGGGSEIVLTQ SPGTLSLSPGERATLSCRASQSVRSSYVAWYQQKPGQAPRLLIYGAS SRATGIPDRFSGSGSGTDFTLTISRLEPEDFAVYYCQQYGDLPFTFG CGTRLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| | | Sequence table | |
| 1243 | CD70_26xCD3-scFc_delGK | bispecific HLE molecule | EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1244 | CD70_27_CCxCD3-scFc_delGK | bispecific HLE molecule | QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1245 | CD70_27xCD3-scFc_delGK | bispecific HLE molecule | QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDTAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1246 | CD70_28_CCxCD3-scFc_delGK | bispecific HLE molecule | EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTA |

TABLE 35-continued

| Sequence table | | | |
|---|---|---|---|
| SEQ ID NO: | Designation | Format/ Source | Sequence |
| | | | YLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1247 | CD70_28xCD3-scFc_delGK | bispecific HLE molecule | EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1248 | CD70_29_CCxCD3-scFc_delGK | bispecific HLE molecule | EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1249 | CD70_29xCD3-scFc_delGK | bispecific HLE molecule | EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGS |

TABLE 35-continued

| Sequence table | | | |
|---|---|---|---|
| SEQ ID NO: | Designation | Format/ Source | Sequence |
| | | | GGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1250 | CD70_30_CCxCD3-scFc_delGK | bispecific HLE molecule | QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1251 | CD70_30xCD3-scFc_delGK | bispecific HLE molecule | QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1252 | CD70_31_CCxCD3-scFc_delGK | bispecific HLE molecule | QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

Sequence table

| SEQ ID NO: | Designation | Format/ Source | Sequence |
|---|---|---|---|
| 1253 | CD70_31xCD 3-scFc_delGK | bispecific HLE molecule | QVQLVESGGGVVQPGRSLRLSCAASGFTFSSYGMHWVRQAPGKGLEW VAVTWYDASNKYYGDAVKGRFTISRDNSKNTLYLQMNSLRAEDTAVY YCARDLLRGVKGYAMDVWGQGTTVTVSSGGGGSGGGGSGGGGSEIVL TQSPGTLSLSPGERATLSCRASQSLRRIYLAWYQQKPGQAPRLLIYD VFDRATGIPDRFSGGGSGTDFTLTISRLEPEDFAVYYCQQYSESPFT FGPGTKVDIKSGGGGSEVQLVESGGGLVQPGGSLKLSCAASGFTFNK YAMNWVRQAPGKGLEWVARIRSKYNNYATYYADSVKDRFTISRDDSK NTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSG NYPNWVQQKPGQAPRGLIGGTKFLAPGTPARFSGSLLGGKAALTLSG VQPEDEAEYYCVLWYSNRWVFGGGTKLTVLGGGGDKTHTCPPCPAPE LLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKA LPAPIEKTISKAKGQPREPQVYTLPPSREEMTKNQVSLTCLVKGFYP SDIAVEWESNGQPENNYKTTPPVLDSDGSFFLYSKLTVDKSRWQQGN VFSCSVMHEALHNHYTQKSLSLSPGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 1254 | CD70_32_CC xCD3- scFc_delGK | bispecific HLE molecule | QVQLVQSGAEVKKPGASVKVSCKASGYTFTSYGISWVRQAPGQCLEW MGWISAYQGYTHYAQKLQGRVTMTTDTSTSTAYMELRSLRSDDTAVY YCARDYGGNDYYGMDVWGQGTTVTVSSGGGGSGGGGSGGGGSQSVLT QPPSASGTPGQRVTISCSGSSSNIGINYVYWYQQLPGTAPKLLIYRS DQRPSGVPDRFSGSKSGTSASLALSGLRSEDEADYYCAAFDESLSGV VFGCGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 1255 | CD70_32xCD 3-scFc_delGK | bispecific HLE molecule | QVQLVQSGAEVKKPGASVKVSCKASGYTFTSYGISWVRQAPGQGLEW MGWISAYQGYTHYAQKLQGRVTMTTDTSTSTAYMELRSLRSDDTAVY YCARDYGGNDYYGMDVWGQGTTVTVSSGGGGSGGGGSGGGGSQSVLT QPPSASGTPGQRVTISCSGSSSNIGINYVYWYQQLPGTAPKLLIYRS DQRPSGVPDRFSGSKSGTSASLALSGLRSEDEADYYCAAFDESLSGV VFGGGTKLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 1256 | CD70_33_CC xCD3- scFc_delGK | bispecific HLE molecule | QAQLVESGGGVVQPGRSLRLSCAASGFTFSYYGMHWVRQAPGKCLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG CGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 35-continued

Sequence table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1257 | CD70_33xCD 3-scFc_delGK | bispecific HLE molecule | QAQLVESGGGVVQPGRSLRLSCAASGFTFSYYGMHWVRQAPGKGLEW VAVIWYDASNKYYADAVKGRFTISRDNSKNTLYLQMNSLRAEDTAVY YCARDREMGSRGDFDYWGQGTLVTVSSGGGGSGGGGSGGGGSDIQMT QSPSSLSASVGDRVTITCRASQGINNYLAWFQQKPGKAPKSLIYAVS ILQSGVPSKFSGSGSGTDFTLTISNLQPEDFATYYCQQYNFYPFSFG QGTKVDIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 1258 | CD70_34_CC xCD3- scFc_delGK | bispecific HLE molecule | QVQLQQWGAGLLKPSETLSLTCAVYGGSFSGFYWSWIRQPPGKCLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGCGT KVEIKSGGGGSEVQLVESGGGLVQPGGSLKLSCAASGFTFNKYAMNW VRQAPGKGLEWVARIRSKYNNYATYYADSVKDRFTISRDDSKNTAYL QMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNW VQQKPGQAPRGLIGGTKFLAPGTPARFSGSLLGGKAALTLSGVQPED EAEYYCVLWYSNRWVFGGGTKLTVLGGGGDKTHTCPPCPAPELLGGP SVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAV EWESNGQPENNYKTTPPVLDSDGSFFLYSKLTVDKSRWQQGNVFSCS VMHEALHNHYTQKSLSLSPGGGGSGGGGSGGGGSGGGGSGGGGSGGG GSDKTHTCPPCPAPELLGGPSVFLFPPKPKDTLMISRTPEVTCVVVD VSHEDPEVKFNWYVDGVEVHNAKTKPCEEQYGSTYRCVSVLTVLHQD WLNGKEYKCKVSNKALPAPIEKTISKAKGQPREPQVYTLPPSREEMT KNQVSLTCLVKGFYPSDIAVEWESNGQPENNYKTTPPVLDSDGSFFL YSKLTVDKSRWQQGNVFSCSVMHEALHNHYTQKSLSLSPGK |
| 1259 | CD70_34xCD 3-scFc_delGK | bispecific HLE molecule | QVQLQQWGAGLLKPSETLSLTCAVYGGSFSGFYWSWIRQPPGKGLEW IGEIYHSGHATNNPSLKSRVTISLDTSKNQFSLKLNSVTAADTAVYY CARGGNSGYIFDYWGQGTLVTVSSGGGGSGGGGSGGGGSDVQMTQSP SSLSASVGDRVTITCRTSQYIGRYLNWYQQKPGKAPKVLIYGASTLQ QGVPSRFSGSGSGTDFTLTITSLQPEDFASYYCQQTYSTPRTFGQGT KVEIKSGGGGSEVQLVESGGGLVQPGGSLKLSCAASGFTFNKYAMNW VRQAPGKGLEWVARIRSKYNNYATYYADSVKDRFTISRDDSKNTAYL QMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNW VQQKPGQAPRGLIGGTKFLAPGTPARFSGSLLGGKAALTLSGVQPED EAEYYCVLWYSNRWVFGGGTKLTVLGGGGDKTHTCPPCPAPELLGGP SVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAV EWESNGQPENNYKTTPPVLDSDGSFFLYSKLTVDKSRWQQGNVFSCS VMHEALHNHYTQKSLSLSPGGGGSGGGGSGGGGSGGGGSGGGGSGGG GSDKTHTCPPCPAPELLGGPSVFLFPPKPKDTLMISRTPEVTCVVVD |

TABLE 35-continued

Sequence table

| SEQ ID NO: | Designation | Format/ Source | Sequence |
|---|---|---|---|
| | | | VSHEDPEVKFNWYVDGVEVHNAKTKPCEEQYGSTYRCVSVLTVLHQD WLNGKEYKCKVSNKALPAPIEKTISKAKGQPREPQVYTLPPSREEMT KNQVSLTCLVKGFYPSDIAVEWESNGQPENNYKTTPPVLDSDGSFFL YSKLTVDKSRWQQGNVFSCSVMHEALHNHYTQKSLSLSPGK |
| 1260 | CD70_35_CC xCD3- scFc_delGK | bispecific HLE molecule | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGCGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 1261 | CD70_35xCD 3-scFc_delGK | bispecific HLE molecule | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTTVTVSSGGGGSGGGGSGGGGSQSVLTQ PPSVSGAPGQRVTISCTGSSSNIGAGYDVNWYQQFPGTAPKLLIYVN NNRPSGVPDRFSGSTSGTSASLAITGLQAEDEADYYCQSYDTSLSAS VFGGGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 1262 | CD70_36_CC xCD3- scFc_delGK | bispecific HLE molecule | QVQLVESGGGVVQPGRSLRLSCAASGFTFSTYGMHWVRQAPGKCLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN NNRPSGVPDRFSGSKSGTSASLAITGLQAEDEADYYCQSYETSLSAS VFGCGTRLTVLSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVLGGGGDKTHTCPPCPAP ELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNK ALPAPIEKTISKAKGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGGGGSGGGGSGGGGSGGGGSGG GGSGGGGSDKTHTCPPCPAPELLGGPSVFLFPPKPKDTLMISRTPEV TCVVVDVSHEDPEVKFNWYVDGVEVHNAKTKPCEEQYGSTYRCVSVL TVLHQDWLNGKEYKCKVSNKALPAPIEKTISKAKGQPREPQVYTLPP SREEMTKNQVSLTCLVKGFYPSDIAVEWESNGQPENNYKTTPPVLDS DGSFFLYSKLTVDKSRWQQGNVFSCSVMHEALHNHYTQKSLSLSPGK |
| 1263 | CD70_36xCD 3-scFc_delGK | bispecific HLE molecule | QVQLVESGGGVVQPGRSLRLSCAASGFTFSTYGMHWVRQAPGKGLEW VAVIWYEGSNKYYGESVKGRFTISRDNSKNTLYLQMNSLRAEDTAVY YCARDNSHYYYGMDVWGQGTLVTVSSGGGGSGGGGSGGGGSQSVLTQ PPSVSGAPGQRVTISCTGSSSNIGAGYDVNWYQQLPGTAPKLLIYVN |

TABLE 35-continued

| Sequence table | | | |
|---|---|---|---|
| SEQ ID NO: | Designation | Format/ Source | Sequence |
| | | | NNRPSGVPDRFSGSKSGTSASLAITGLQAEDEADYYCQSYETSLSAS<br>VFGGGTRLTVLSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQG<br>NVFSCSVMHEALHNHYTQKSLSLSPGGGGSGGGGSGGGGSGGGGSGG<br>GGSGGGGSDKTHTCPPCPAPELLGGPSVFLFPPKPKDTLMISRTPEV<br>TCVVVDVSHEDPEVKFNWYVDGVEVHNAKTKPCEEQYGSTYRCVSVL<br>TVLHQDWLNGKEYKCKVSNKALPAPIEKTISKAKGQPREPQVYTLPP<br>SREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK |
| 1264 | CD70_37_CC xCD3-scFc_delGK | bispecific HLE molecule | QMQLQESGPGLVKPSETLSLTCTVSGGSIESGVYYWSWIRQPPGKCL<br>EWIGYIYYSGSTSYNPSLKSRLTMSVDTSKNQFSLKLSSVTAADTAV<br>YYCARSGYSYALFDYWGQGTLVTVSSGGGGSGGGGSGGGGSDIQMTQ<br>SPSSLSASLGDRVTITCRASQSVDRYFNWYQQKPGKAPKVLIFAASS<br>LQSGVPSRFSGSGSGTDFTLTISSLQPEDFATYYCQQSYSTPWTFGC<br>GTKVEVKSGGGGSEVQLVESGGGLVQPGGSLKLSCAASGFTFNKYAM<br>NWVRQAPGKGLEWVARIRSKYNNYATYYADSVKDRFTISRDDSKNTA<br>YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVLGGGGDKTHTCPPCPAPELLG<br>GPSVFLFPPKPKDTLMISRTPEVTCVVVDVSHEDPEVKFNWYVDGVE<br>VHNAKTKPCEEQYGSTYRCVSVLTVLHQDWLNGKEYKCKVSNKALPA<br>PIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFS<br>CSVMHEALHNHYTQKSLSLSPGGGGSGGGGSGGGGSGGGGSGGGGSG<br>GGGSDKTHTCPPCPAPELLGGPSVFLFPPKPKDTLMISRTPEVTCVV<br>VDVSHEDPEVKFNWYVDGVEVHNAKTKPCEEQYGSTYRCVSVLTVLH<br>QDWLNGKEYKCKVSNKALPAPIEKTISKAKGQPREPQVYTLPPSREE<br>MTKNQVSLTCLVKGFYPSDIAVEWESNGQPENNYKTTPPVLDSDGSF<br>FLYSKLTVDKSRWQQGNVFSCSVMHEALHNHYTQKSLSLSPGK |
| 1265 | CD70_37xCD 3-scFc_delGK | bispecific HLE molecule | QMQLQESGPGLVKPSETLSLTCTVSGGSIESGVYYWSWIRQPPGKGL<br>EWIGYIYYSGSTSYNPSLKSRLTMSVDTSKNQFSLKLSSVTAADTAV<br>YYCARSGYSYALFDYWGQGTLVTVSSGGGGSGGGGSGGGGSDIQMTQ<br>SPSSLSASLGDRVTITCRASQSVDRYFNWYQQKPGKAPKVLIFAASS<br>LQSGVPSRFSGSGSGTDFTLTISSLQPEDFATYYCQQSYSTPWTFGQ<br>GTKVEVKSGGGGSEVQLVESGGGLVQPGGSLKLSCAASGFTFNKYAM<br>NWVRQAPGKGLEWVARIRSKYNNYATYYADSVKDRFTISRDDSKNTA<br>YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVLGGGGDKTHTCPPCPAPELLG<br>GPSVFLFPPKPKDTLMISRTPEVTCVVVDVSHEDPEVKFNWYVDGVE<br>VHNAKTKPCEEQYGSTYRCVSVLTVLHQDWLNGKEYKCKVSNKALPA<br>PIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFS<br>CSVMHEALHNHYTQKSLSLSPGGGGSGGGGSGGGGSGGGGSGGGGSG<br>GGGSDKTHTCPPCPAPELLGGPSVFLFPPKPKDTLMISRTPEVTCVV<br>VDVSHEDPEVKFNWYVDGVEVHNAKTKPCEEQYGSTYRCVSVLTVLH<br>QDWLNGKEYKCKVSNKALPAPIEKTISKAKGQPREPQVYTLPPSREE<br>MTKNQVSLTCLVKGFYPSDIAVEWESNGQPENNYKTTPPVLDSDGSF<br>FLYSKLTVDKSRWQQGNVFSCSVMHEALHNHYTQKSLSLSPGK |
| 1266 | CD70_38_CC xCD3-scFc_delGK | bispecific HLE molecule | QVQLQESGPGLVKPSQTLSLTCTVSGDSIISGGYYWSWIRQPPGKCL<br>EWIGYIFYSGSTDYNPSLKSRVTISVDTSKNQFSLKLSSVTAADTAV<br>YYCARSGYSYALFDAWGQGTLVTVSSGGGGSGGGGSGGGGSDIQMTQ<br>SPSSLSASVGDRVTISCRASQFIGRYFNWYQQKPGKAPKVLIYAESS<br>LQSGVPSRFSGSGSGTEFTLTISSLQPEDFATYYCQQSYSTPWTFGC<br>GTKVEIKSGGGGSEVQLVESGGGLVQPGGSLKLSCAASGFTFNKYAM<br>NWVRQAPGKGLEWVARIRSKYNNYATYYADSVKDRFTISRDDSKNTA<br>YLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYP<br>NWVQQKPGQAPRGLIGGTKFLAPGTPARFSGSLLGGKAALTLSGVQP<br>EDEAEYYCVLWYSNRWVFGGGTKLTVLGGGGDKTHTCPPCPAPELLG<br>GPSVFLFPPKPKDTLMISRTPEVTCVVVDVSHEDPEVKFNWYVDGVE<br>VHNAKTKPCEEQYGSTYRCVSVLTVLHQDWLNGKEYKCKVSNKALPA |

TABLE 35-continued

| SEQ ID NO: | Designation | Format/ Source | Sequence |
|---|---|---|---|
| | | | PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGGGGSGGGGSGGGGSGGGGSGGGGSG GGGSDKTHTCPPCPAPELLGGPSVFLFPPKPKDTLMISRTPEVTCVV VDVSHEDPEVKFNWYVDGVEVHNAKTKPCEEQYGSTYRCVSVLTVLH QDWLNGKEYKCKVSNKALPAPIEKTISKAKGQPREPQVYTLPPSREE MTKNQVSLTCLVKGFYPSDIAVEWESNGQPENNYKTTPPVLDSDGSF FLYSKLTVDKSRWQQGNVFSCSVMHEALHNHYTQKSLSLSPGK |
| 1267 | CD70_38xCD 3-scFc_delGK | bispecific HLE molecule | QVQLQESGPGLVKPSQTLSLTCTVSGDSIISGGYYWSWIRQPPGKGL EWIGYIFYSGSTDYNPSLKSRVTISVDTSKNQFSLKLSSVTAADTAV YYCARSGYSYALFDAWGQGTLVTVSSGGGGSGGGGSGGGGSDIQMTQ SPSSLSASVGDRVTISCRASQFIGRYFNWYQQKPGKAPKVLIYAESS LQSGVPSRFSGSGSGTEFTLTISSLQPEDFATYYCQQSYSTPWTFGQ GTKVEIKSGGGGSEVQLVESGGGLVQPGGSLKLSCAASGFTFNKYAM NWVRQAPGKGLEWVARIRSKYNNYATYYADSVKDRFTISRDDSKNTA YLQMNNLKTEDTAVYYCVRHGNFGNSYISYWAYWGQGTLVTVSSGGG GSGGGGSGGGGSQTVVTQEPSLTVSPGGTVTLTCGSSTGAVTSGNYP NWVQQKPGQAPRGLIGGTKFLAPGTPARFSGSLLGGKAALTLSGVQP EDEAEYYCVLWYSNRWVFGGGTKLTVLGGGGDKTHTCPPCPAPELLG GPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPA PIEKTISKAKGQPREPQVYTLPPSREEMTKNQVSLTCLVKGFYPSDI AVEWESNGQPENNYKTTPPVLDSDGSFFLYSKLTVDKSRWQQGNVFS CSVMHEALHNHYTQKSLSLSPGGGGSGGGGSGGGGSGGGGSGGGGSG GGGSDKTHTCPPCPAPELLGGPSVFLFPPKPKDTLMISRTPEVTCVV VDVSHEDPEVKFNWYVDGVEVHNAKTKPCEEQYGSTYRCVSVLTVLH QDWLNGKEYKCKVSNKALPAPIEKTISKAKGQPREPQVYTLPPSREE MTKNQVSLTCLVKGFYPSDIAVEWESNGQPENNYKTTPPVLDSDGSF FLYSKLTVDKSRWQQGNVFSCSVMHEALHNHYTQKSLSLSPGK |
| 1268 | CD20-HLE | scFc | QVQLVQSGAEVKKPGSSVKVSCKASGYAFSYSWINWVRQAPGQGLEW MGRIFPGDGDTDYNGKFKGRVTITADKSTSTAYMELSSLRSEDTAVY YCARNVFDGYWLVYWGQGTLVTVSSGGGGSGGGGSGGGGSDIVMTQT PLSLPVTPGEPASISCRSSKSLLHSNGITYLYWYLQKPGQSPQLLIY QMSNLVSGVPDRFSGSGSGTDFTLKISRVEAEDVGVYYCAQNLELPY TFGGGTKVEIKSGGGGSEVQLVESGGGLVQPGGSLKLSCAASGFTFN KYAMNWVRQAPGKGLEWVARIRSKYNNYATYYADSVKDRFTISRDDS KNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTS GNYPNWVQQKPGQAPRGLIGGTKFLAPGTPARFSGSLLGGKAALTLS GVQPEDEAEYYCVLWYSNRWVFGGGTKLTVL |
| 1269 | CD19 9-B7 CC x I2C0-scFc | VH CDR1 | NYGMH |
| 1270 | CD19 9-B7 CC x I2C0-scFc | VH CDR2 | AIGWEGSNKYYAEPVKG |
| 1271 | CD19 9-B7 CC x I2C0-scFc | VH CDR3 | DRGTIFGYYGMDV |
| 1272 | CD19 9-B7 CC x I2C0-scFc | VL CDR1 | RSSQSLLHSNRFNYLD |
| 1273 | CD19 9-B7 CC x I2C0-scFc | VL CDR2 | LGSNRAS |
| 1274 | CD19 9-B7 CC x I2C0-scFc | VL CDR3 | MQALQTPLT |
| 1275 | CD19 9-B7 CC x I2C0-scFc | VH | QVQLVESGGGVVQPGRSLRLSCEASGFIVSNYGIVIHWVRQAPGKCLE WVAAIGWEGSNKYYAEPVKGRFTISRDKSKNTLSLQMSSLRAEDTAL YYCARDRGTIFGYYGMDVWGQGTTVTVSS |
| 1276 | CD19 9-B7 CC x I2C0-scFc | VL | DIVMTQSPLSLPVTPGEPASISCRSSQSLLHSNRFNYLDWYLQKPGQS PQLLIYLGSNRASGVPDRFSGSGSGTDFTLKISRVEAEDVGVYYCMQA LQTPLTFACGTKVEIK |

TABLE 35-continued

| Sequence table | | | |
|---|---|---|---|
| SEQ ID NO: | Designation | Format/ Source | Sequence |
| 1277 | CD19 9-B7 CC x I2C0-scFc | scFv | DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSS |
| 1278 | CD19 9-B7 CC x I2C0-scFc | bispecific molecule | DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1279 | CD19 9-B7 CC x I2C0-scFc | bispecific HLE molecule | DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1280 | CD19 9-B7 CC x I2C0-scFc_delGK | bispecific HLE molecule | DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1281 | CD19 8-C2 CC x I2C0-scFc | VH CDR1 | SYGIH |
| 1282 | CD19 8-C2 CC x I2C0-scFc | VH CDR2 | LTSYEGGNKYYAESVKG |

TABLE 35-continued

| SEQ ID NO: | Designation | Format/ Source | Sequence |
|---|---|---|---|
| | | Sequence table | |
| 1283 | CD19 8-C2 CC x I2C0-scFc | VH CDR3 | DRGTIFGDYGMDV |
| 1284 | CD19 8-C2 CC x I2C0-scFc | VL CDR1 | RSSQSLLHKNAFNYLD |
| 1285 | CD19 8-C2 CC x I2C0-scFc | VL CDR2 | LGSNRAS |
| 1286 | CD19 8-C2 CC x I2C0-scFc | VL CDR3 | MQALQTPFT |
| 1287 | CD19 8-C2 CC x I2C0-scFc | VH | QVQLVESGGGVVQPGRSLRLSCAASGFTFSSYGIHWVRQAPGKCLE WVALTSYEGGNKYYAESVKGRFTISRDNSKNTLYLQMNSLRAEDTAV YYCAKDRGTIFGDYGMDVWGQGTTVTVSS |
| 1288 | CD19 8-C2 CC x I2C0-scFc | VL | DIVMTQSPLSLPVTPGEPASISCRSSQSLLHKNAFNYLDWYLQKPGQS PQLLIYLGSNRASGVPDRFSGSGSGTDFTLKISRVEAEDVGVYYCMQA LQTPFTFGCGTKVEIK |
| 1289 | CD19 8-C2 CC x I2C0-scFc | scFv | DIVMTQSPLSLPVTPGEPASISCRSSQSLLHKNAFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSS |
| 1290 | CD19 8-C2 CC x I2C0-scFc | bispecific molecule | DIVMTQSPLSLPVTPGEPASISCRSSQSLLHKNAFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVL |
| 1291 | CD19 8-C2 CC x I2C0-scFc | bispecific HLE molecule | DIVMTQSPLSLPVTPGEPASISCRSSQSLLHKNAFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGKGGGGSGGGGSGG GGSGGGGSGGGGSGGGGSDKTHTCPPCPAPELLGGPSVFLFPPKPK DTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPEN NYKTTPPVLDSDGSFFLYSKLTVDKSRWQQGNVFSCSVMHEALHNH YTQKSLSLSPGK |
| 1292 | CD19 8-C2 CC x I2C0-scFc_delGK | bispecific HLE molecule | DIVMTQSPLSLPVTPGEPASISCRSSQSLLHKNAFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ |

TABLE 35-continued

| Sequence table | | | |
|---|---|---|---|
| SEQ ID NO: | Designation | Format/ Source | Sequence |
| | | | GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGGGGSGGGGSGGGG SGGGGSGGGGSGGGGSDKTHTCPPCPAPELLGGPSVFLFPPKPKDTL MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |
| 1293 | CD19 8-C8 CC x I2C0-scFc | VH CDR1 | SYGIH |
| 1294 | CD19 8-C8 CC x I2C0-scFc | VH CDR2 | LTSYEGGNKYYAESVKG |
| 1295 | CD19 8-C8 CC x I2C0-scFc | VH CDR3 | DRGTIFGDYGMDV |
| 1296 | CD19 8-C8 CC x I2C0-scFc | VL CDR1 | RSSQSLLHQNRFNYLD |
| 1297 | CD19 8-C8 CC x I2C0-scFc | VL CDR2 | LGSNRAS |
| 1298 | CD19 8-C8 CC x I2C0-scFc | VL CDR3 | MQALQTPFT |
| 1299 | CD19 8-C8 CC x I2C0-scFc | VH | QVQLVESGGGVVQPGRSLRLSCAASGFTFSSYGIHWVRQAPGKCLE WVALTSYEGGNKYYAESVKGRFTISRDNSKNTLYLQMNSLRAEDTAV YYCAKDRGTIFGDYGMDVWGQGTTVTVSS |
| 1300 | CD19 8-C8 CC x I2C0-scFc | VL | DIVMTQSPLSLPVTPGEPASISCRSSQSLLHQNRFNYLDWYLQKPGQS PQLLIYLGSNRASGVPDRFSGSGSGTDFTLKISRVEAEDVGVYYCMQA LQTPFTFGCGTKVEIK |
| 1301 | CD19 8-C8 CC x I2C0-scFc | scFv | DIVMTQSPLSLPVTPGEPASISCRSSQSLLHQNRFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSS |
| 1302 | CD19 8-C8 CC x I2C0-scFc | bispecific molecule | DIVMTQSPLSLPVTPGEPASISCRSSQSLLHQNRFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVL |
| 1303 | CD19 8-C8 CC x I2C0-scFc | bispecific HLE molecule | DIVMTQSPLSLPVTPGEPASISCRSSQSLLHQNRFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS |

TABLE 35-continued

Sequence table

| SEQ ID NO: | Designation | Format/ Source | Sequence |
|---|---|---|---|
| | | | STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGKGGGGSGGGGSGG GGSGGGGSGGGGSGGGGSDKTHTCPPCPAPELLGGPSVFLFPPKPK DTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPEN NYKTTPPVLDSDGSFFLYSKLTVDKSRWQQGNVFSCSVMHEALHNH YTQKSLSLSPGK |
| 1304 | CD19 8-C8 CC x I2C0-scFc_delGK | bispecific HLE molecule | DIVMTQSPLSLPVTPGEPASISCRSSQSLLHQNRFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGGGGSGGGGSGGGG SGGGGSGGGGSGGGGSDKTHTCPPCPAPELLGGPSVFLFPPKPKDTL MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |
| 1305 | CD19 8-C9 CC x I2C0-scFc | VH CDR1 | SYGIH |
| 1306 | CD19 8-C9 CC x I2C0-scFc | VH CDR2 | LTSYEGGNKYYAESVKG |
| 1307 | CD19 8-C9 CC x I2C0-scFc | VH CDR3 | DRGTIFGDYGMEV |
| 1308 | CD19 8-C9 CC x I2C0-scFc | VL CDR1 | RSSQSLLHPNKLNYLD |
| 1309 | CD19 8-C9 CC x I2C0-scFc | VL CDR2 | LGSNRAS |
| 1310 | CD19 8-C9 CC x I2C0-scFc | VL CDR3 | MQALQTPFT |
| 1311 | CD19 8-C9 CC x I2C0-scFc | VH | QVQLVESGGGVVQPGRSLRLSCAASGFTFSSYGIHWVRQAPGKCLE WVALTSYEGGNKYYAESVKGRFTISRDNSKNTLYLQMNSLRAEDTAV YYCAKDRGTIFGDYGMEVWGQGTTVTVSS |
| 1312 | CD19 8-C9 CC x I2C0-scFc | VL | DIVMTQSPLSLPVTPGEPASISCRSSQSLLHPNKLNYLDWYMQKPGQ SPQLLIYLGSNRASGVPDRFSGSGSGTDFTLKISRVEAEDVGVYYCMQ ALQTPFTFGCGTKVEIK |
| 1313 | CD19 8-C9 CC x I2C0-scFc | scFv | DIVMTQSPLSLPVTPGEPASISCRSSQSLLHPNKLNYLDWYMQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MEVWGQGTTVTVSS |

TABLE 35-continued

| SEQ ID NO: | Designation | Format/ Source | Sequence |
|---|---|---|---|
| | | Sequence table | |
| 1314 | CD19 8-C9 CC x I2C0-scFc | bispecific molecule | DIVMTQSPLSLPVTPGEPASISCRSSQSLLHPNKLNYLDWYMQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MEVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVL |
| 1315 | CD19 8-C9 CC x I2C0-scFc | bispecific HLE molecule | DIVMTQSPLSLPVTPGEPASISCRSSQSLLHPNKLNYLDWYMQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MEVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGKGGGGSGGGGSGG GGSGGGGSGGGGSGGGGSDKTHTCPPCPAPELLGGPSVFLFPPKPK DTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPEN NYKTTPPVLDSDGSFFLYSKLTVDKSRWQQGNVFSCSVMHEALHNH YTQKSLSLSPGK |
| 1316 | CD19 8-C9 CC x I2C0-scFc_delGK | bispecific HLE molecule | DIVMTQSPLSLPVTPGEPASISCRSSQSLLHPNKLNYLDWYMQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MEVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGGGGSGGGGSGGGG SGGGGSGGGGSGGGGSDKTHTCPPCPAPELLGGPSVFLFPPKPKDTL MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |
| 1317 | CD19 8-D1 CC x I2C0-scFc | VH CDR1 | SYGIH |
| 1318 | CD19 8-D1 CC x I2C0-scFc | VH CDR2 | LTSYEGGNKYYAESVKG |
| 1319 | CD19 8-D1 CC x I2C0-scFc | VH CDR3 | DRGTIFGDYGMDV |
| 1320 | CD19 8-D1 CC x I2C0-scFc | VL CDR1 | RSSQSLLHKNRFNYLD |

TABLE 35-continued

Sequence table

| SEQ ID NO: | Designation | Format/ Source | Sequence |
|---|---|---|---|
| 1321 | CD19 8-D1 CC x I2C0-scFc | VL CDR2 | LGSNRAS |
| 1322 | CD19 8-D1 CC x I2C0-scFc | VL CDR3 | MQALQTPFT |
| 1323 | CD19 8-D1 CC x I2C0-scFc | VH | QVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS |
| 1324 | CD19 8-D1 CC x I2C0-scFc | VL | DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIK |
| 1325 | CD19 8-D1 CC x I2C0-scFc | scFv | DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS |
| 1326 | CD19 8-D1 CC x I2C0-scFc | bispecific molecule | DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1327 | CD19 8-D1 CC x I2C0-scFc | bispecific HLE molecule | DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1328 | CD19 8-D1 CC x I2C0-scFc_delGK | bispecific HLE molecule | DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTL |

TABLE 35-continued

| Sequence table | | | |
|---|---|---|---|
| SEQ ID NO: | Designation | Format/ Source | Sequence |
| | | | MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |
| 1329 | CD19 9-A8 CC x I2C0-scFc | VH CDR1 | SYGIH |
| 1330 | CD19 9-A8 CC x I2C0-scFc | VH CDR2 | LTSYEGGNKYYAESVKG |
| 1331 | CD19 9-A8 CC x I2C0-scFc | VH CDR3 | DRGTIFGDYGMDV |
| 1332 | CD19 9-A8 CC x I2C0-scFc | VL CDR1 | RSSQSLLHRNSWNYLD |
| 1333 | CD19 9-A8 CC x I2C0-scFc | VL CDR2 | LGSNRAS |
| 1334 | CD19 9-A8 CC x I2C0-scFc | VL CDR3 | MQALQTPFT |
| 1335 | CD19 9-A8 CC x I2C0-scFc | VH | QVQLVESGGGVVQPGRSLRLSCAASGFTFSSYGIHWVRQAPGKCLE WVALTSYEGGNKYYAESVKGRFTISRDNSKNTLYLQMNSLRAEDTAV YYCAKDRGTIFGDYGMDVWGQGTTVTVSS |
| 1336 | CD19 9-A8 CC x I2C0-scFc | VL | DIVMTQSPLSLPVTPGEPASISCRSSQSLLHRNSWNYLDWYLQKPGQ SPQLLIYLGSNRASGVPDRFSGSGSGTDFTLKISRVEAEDVGVYYCMQ ALQTPFTFGCGTKVEIK |
| 1337 | CD19 9-A8 CC x I2C0-scFc | scFv | DIVMTQSPLSLPVTPGEPASISCRSSQSLLHRNSWNYLDWYLQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSS |
| 1338 | CD19 9-A8 CC x I2C0-scFc | bispecific molecule | DIVMTQSPLSLPVTPGEPASISCRSSQSLLHRNSWNYLDWYLQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVL |
| 1339 | CD19 9-A8 CC x I2C0-scFc | bispecific HLE molecule | DIVMTQSPLSLPVTPGEPASISCRSSQSLLHRNSWNYLDWYLQKPGQ SPQLLIYLGSNRASGVPDRFSGSGSGTDFTLKISRVEAEDVGVYYCMQ ALQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGKGGGGSGGGGSGG GGSGGGGSGGGGSGGGGSDKTHTCPPCPAPELLGGPSVFLFPPKPK DTLMISRTPEVTCVVVDVSHEDPEVKFNWYVDGVEVHNAKTKPCEE |

TABLE 35-continued

Sequence table

| SEQ ID NO: | Designation | Format/ Source | Sequence |
|---|---|---|---|
| | | | QYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1340 | CD19 9-A8 CC x I2C0-scFc_delGK | bispecific HLE molecule | DIVMTQSPLSLPVTPGEPASISCRSSQSLLHRNSWNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1341 | CD19 9-C1 CC x I2C0-scFc | VH CDR1 | SYGIH |
| 1342 | CD19 9-C1 CC x I2C0-scFc | VH CDR2 | LTSYEGGNKYYAESVKG |
| 1343 | CD19 9-C1 CC x I2C0-scFc | VH CDR3 | DRGTIFGDYGMDV |
| 1344 | CD19 9-C1 CC x I2C0-scFc | VL CDR1 | RSSQSLLHPNHFNYLD |
| 1345 | CD19 9-C1 CC x I2C0-scFc | VL CDR2 | LGSNRAS |
| 1346 | CD19 9-C1 CC x I2C0-scFc | VL CDR3 | MQALQTPFT |
| 1347 | CD19 9-C1 CC x I2C0-scFc | VH | QVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS |
| 1348 | CD19 9-C1 CC x I2C0-scFc | VL | DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIK |
| 1349 | CD19 9-C1 CC x I2C0-scFc | scFv | DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS |
| 1350 | CD19 9-C1 CC x I2C0-scFc | bispecific molecule | DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQ |

TABLE 35-continued

| Sequence table | | | |
|---|---|---|---|
| SEQ ID NO: | Designation | Format/ Source | Sequence |
| | | | GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVL |
| 1351 | CD19 9-C1 CC x I2C0-scFc | bispecific HLE molecule | DIVMTQSPLSLPVTPGEPASISCRSSQSLLHPNHFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGKGGGGSGGGGSGG GGSGGGGSGGGGSGGGGSDKTHTCPPCPAPELLGGPSVFLFPPKPK DTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPEN NYKTTPPVLDSDGSFFLYSKLTVDKSRWQQGNVFSCSVMHEALHNH YTQKSLSLSPGK |
| 1352 | CD19 9-C1 CC x I2C0-scFc | bispecific HLE molecule | DIVMTQSPLSLPVTPGEPASISCRSSQSLLHPNHFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGGGGSGGGGSGGGG SGGGGSGGGGSGGGGSDKTHTCPPCPAPELLGGPSVFLFPPKPKDTL MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |
| 1353 | CD19 0-B6 CC x I2C0-scFc | VH CDR1 | SYGIH |
| 1354 | CD19 0-B6 CC x I2C0-scFc | VH CDR2 | LTSYEGGNKYYAESVKG |
| 1355 | CD19 0-B6 CC x I2C0-scFc | VH CDR3 | DRGTIFGDYGMDV |
| 1356 | CD19 0-B6 CC x I2C0-scFc | VL CDR1 | RSSQSLLHKNSFNYLD |
| 1357 | CD19 0-B6 CC x I2C0-scFc | VL CDR2 | LGSNRAS |
| 1358 | CD19 0-B6 CC x I2C0-scFc | VL CDR3 | MQALQTPFT |

TABLE 35-continued

Sequence table

| SEQ ID NO: | Designation | Format/ Source | Sequence |
|---|---|---|---|
| 1359 | CD19 0-B6 CC x I2C0-scFc | VH | QVQLVESGGGVVQPGRSLRLSCAASGFTFSSYGIHWVRQAPGKCLE WVALTSYEGGNKYYAESVKGRFTISRDNSKNTLYLQMNSLRAEDTAV YYCAKDRGTIFGDYGMDVWGQGTTVTVSS |
| 1360 | CD19 0-B6 CC x I2C0-scFc | VL | DIVMTQSPLSLPVTPGEPASISCRSSQSLLHKNSFNYLDWYLQKPGQS PQLLIYLGSNRASGVPDRFSGSGSGTDFTLKISRVEAEDVGVYYCMQA LQTPFTFGCGTKVEIK |
| 1361 | CD19 0-B6 CC x I2C0-scFc | scFv | DIVMTQSPLSLPVTPGEPASISCRSSQSLLHKNSFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSS |
| 1362 | CD19 0-B6 CC x I2C0-scFc | bispecific molecule | DIVMTQSPLSLPVTPGEPASISCRSSQSLLHKNSFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVL |
| 1363 | CD19 0-B6 CC x I2C0-scFc | bispecific HLE molecule | DIVMTQSPLSLPVTPGEPASISCRSSQSLLHKNSFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGKGGGGSGGGGSGG GGSGGGGSGGGGSGGGGSDKTHTCPPCPAPELLGGPSVFLFPPKPK DTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPEN NYKTTPPVLDSDGSFFLYSKLTVDKSRWQQGNVFSCSVMHEALHNH YTQKSLSLSPGK |
| 1364 | CD19 0-B6 CC x I2C0-scFc_delGK | bispecific HLE molecule | DIVMTQSPLSLPVTPGEPASISCRSSQSLLHKNSFNYLDWYLQKPGQS PQLLIYLGSNRASGVPDRFSGSGSGTDFTLKISRVEAEDVGVYYCMQA LQTPFTFGCGTKVEIKGGGGSGGGGSGGGGSQVQLVESGGGVVQP GRSLRLSCAASGFTFSSYGIHWVRQAPGKCLEWVALTSYEGGNKYYA ESVKGRFTISRDNSKNTLYLQMNSLRAEDTAVYYCAKDRGTIFGDYG MDVWGQGTTVTVSSGGGGSEVQLVESGGGLVQPGGSLKLSCAASG FTFNKYAMNWVRQAPGKGLEWVARIRSKYNNYATYYADSVKDRFTI SRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGS STGAVTSGNYPNWVQQKPGQAPRGLIGGTKFLAPGTPARFSGSLLG GKAALTLSGVQPEDEAEYYCVLWYSNRWVFGGGTKLTVLGGGGDKT HTCPPCPAPELLGGPSVFLFPPKPKDTLMISRTPEVTCVVVDVSHEDPE VKFNWYVDGVEVHNAKTKPCEEQYGSTYRCVSVLTVLHQDWLNGKE YKCKVSNKALPAPIEKTISKAKGQPREPQVYTLPPSREEMTKNQVSLTC LVKGFYPSDIAVEWESNGQPENNYKTTPPVLDSDGSFFLYSKLTVDKS RWQQGNVFSCSVMHEALHNHYTQKSLSLSPGGGGSGGGGSGGGG SGGGGSGGGGSGGGGSDKTHTCPPCPAPELLGGPSVFLFPPKPKDTL MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |

TABLE 35-continued

| Sequence table | | | |
|---|---|---|---|
| SEQ ID NO: | Designation | Format/ Source | Sequence |
| 1365 | CD19 0-C12 CC x I2C0-scFc | VH CDR1 | SYGIH |
| 1366 | CD19 0-C12 CC x I2C0-scFc | VH CDR2 | LTSYEGGNKYYAESVKG |
| 1367 | CD19 0-C12 CC x I2C0-scFc | VH CDR3 | DRGTIFGDYGMDV |
| 1368 | CD19 0-C12 CC x I2C0-scFc | VL CDR1 | RSSQSLLHKNHFNYLD |
| 1369 | CD19 0-C12 CC x I2C0-scFc | VL CDR2 | LGSNRAS |
| 1370 | CD19 0-C12 CC x I2C0-scFc | VL CDR3 | MQALQTPFT |
| 1371 | CD19 0-C12 CC x I2C0-scFc | VH | QVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS |
| 1372 | CD19 0-C12 CC x I2C0-scFc | VL | DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIK |
| 1373 | CD19 0-C12 CC x I2C0-scFc | scFv | DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS |
| 1374 | CD19 0-C12 CC x I2C0-scFc | bispecific molecule | DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1375 | CD19 0-C12 CC x I2C0-scFc | bispecific HLE molecule | DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| 1376 | CD19 0-C12 CC x I2C0-scFc_delGK | bispecific HLE molecule | DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1377 | CD19 4-C1RE-B10 CC x I2C0-scFc | VH CDR1 | NYGMH |
| 1378 | CD19 4-C1RE-B10 CC x I2C0-scFc | VH CDR2 | VMSWEGSNKYYAEPVKG |
| 1379 | CD19 4-C1RE-B10 CC x I2C0-scFc | VH CDR3 | DRGTIFGYYGMDV |
| 1380 | CD19 4-C1RE-B10 CC x I2C0-scFc | VL CDR1 | RSSQSLLHKNNFNYLD |
| 1381 | CD19 4-C1RE-B10 CC x I2C0-scFc | VL CDR2 | LGSNRAS |
| 1382 | CD19 4-C1RE-B10 CC x I2C0-scFc | VL CDR3 | MQALQTPLT |
| 1383 | CD19 4-C1RE-B10 CC x I2C0-scFc | VH | QVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSS |
| 1384 | CD19 4-C1RE-B10 CC x I2C0-scFc | VL | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIK |
| 1385 | CD19 4-C1RE-B10 CC x I2C0-scFc | scFv | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSS |
| 1386 | CD19 4-C1RE-B10 CC x I2C0-scFc | bispecific molecule | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |

TABLE 35-continued

| Sequence table | | | |
|---|---|---|---|
| SEQ ID NO: | Designation | Format/ Source | Sequence |
| 1387 | CD19 4-C1RE-B10 CC x I2C0-scFc | bispecific HLE molecule | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1388 | CD19 4-C1RE-B10CC x I2C0-scFc_delGK | bispecific HLE molecule | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1389 | CD19 97-G1RE CC x I2C0-scFc | VH CDR1 | SYGMH |
| 1390 | CD19 97-G1RE CC x I2C0-scFc | VH CDR2 | VISYEGSNKYYAESVKG |
| 1391 | CD19 97-G1RE CC x I2C0-scFc | VH CDR3 | DRGTIFGNYGLEV |
| 1392 | CD19 97-G1RE CC x I2C0-scFc | VL CDR1 | RSSQSLLHGNRFNYLD |
| 1393 | CD19 97-G1RE CC x I2C0-scFc | VL CDR2 | LGSNRAS |
| 1394 | CD19 97-G1RE CC x I2C0-scFc | VL CDR3 | MQALQTPFT |
| 1395 | CD19 97-G1RE CC x I2C0-scFc | VH | QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |

TABLE 35-continued

| SEQ ID NO: | Designation | Format/ Source | Sequence |
|---|---|---|---|
| Sequence table | | | |
| 1396 | CD19 97-G1RE CC x I2C0-scFc | VL | DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIK |
| 1397 | CD19 97-G1RE CC x I2C0-scFc | scFv | DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |
| 1398 | CD19 97-G1RE CC x I2C0-scFc | bispecific molecule | DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1399 | CD19 97-G1RE CC x I2C0-scFc | bispecific HLE molecule | DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1400 | CD19 97-G1RE CC x I2C0-scFc_delGK | bispecific HLE molecule | DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1401 | CD19 97-G1RE-C2 CC x I2C0-scFc | VH CDR1 | SYGMH |

TABLE 35-continued

| SEQ ID NO: | Designation | Format/ Source | Sequence |
|---|---|---|---|
| 1402 | CD19 97-G1RE-C2 CC x I2C0-scFc | VH CDR2 | VISYEGSNKYYAESVKG |
| 1403 | CD19 97-G1RE-C2 CC x I2C0-scFc | VH CDR3 | DRGTIFGNYGLEV |
| 1404 | CD19 97-G1RE-C2 CC x I2C0-scFc | VL CDR1 | RSSQSLLHKNAFNYLD |
| 1405 | CD19 97-G1RE-C2 CC x I2C0-scFc | VL CDR2 | LGSNRAS |
| 1406 | CD19 97-G1RE-C2 CC x I2C0-scFc | VL CDR3 | MQALQTPFT |
| 1407 | CD19 97-G1RE-C2 CC x I2C0-scFc | VH | QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |
| 1408 | CD19 97-G1RE-C2 CC x I2C0-scFc | VL | DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIK |
| 1409 | CD19 97-G1RE-C2 CC x I2C0-scFc | scFv | DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |
| 1410 | CD19 97-G1RE-C2 CC x I2C0-scFc | bispecific molecule | DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1411 | CD19 97-G1RE-C2 CC x I2C0-scFc | bispecific HLE molecule | DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| 1412 | CD19 97-G1RE-C2 CC x I2C0-scFc_delGK | bispecific HLE molecule | DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1413 | CD19 97-G1RE-B5 CC x I2C0-scFc | VH CDR1 | SYGMH |
| 1414 | CD19 97-G1RE-B5 CC x I2C0-scFc | VH CDR2 | VISYEGSNKYYAESVKG |
| 1415 | CD19 97-G1RE-B5 CC x I2C0-scFc | VH CDR3 | DRGTIFGNYGLEV |
| 1416 | CD19 97-G1RE-B5 CC x I2C0-scFc | VL CDR1 | RSSQSLLHKNKWNYLD |
| 1417 | CD19 97-G1RE-B5 CC x I2C0-scFc | VL CDR2 | LGSNRAS |
| 1418 | CD19 97-G1RE-B5 CC x I2C0-scFc | VL CDR3 | MQALQTPFT |
| 1419 | CD19 97-G1RE-B5 CC x I2C0-scFc | VH | QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |
| 1420 | CD19 97-G1RE-B5 CC x I2C0-scFc | VL | DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIK |
| 1421 | CD19 97-G1RE-B5 CC x I2C0-scFc | scFv | DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |
| 1422 | CD19 97-G1RE-B5 CC x I2C0-scFc | bispecific molecule | DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |

TABLE 35-continued

| SEQ ID NO: | Designation | Format/ Source | Sequence |
|---|---|---|---|
| | | Sequence table | |
| 1423 | CD19 97-G1RE-B5 CC x I2C0-scFc | bispecific HLE molecule | DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1424 | CD19 97-G1RE-B5 CC x I2C0-scFc_delGK | bispecific HLE molecule | DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1425 | CD19 97-G1RE-B10 CC x I2C0-scFc | VH CDR1 | SYGMH |
| 1426 | CD19 97-G1RE-B10 CC x I2C0-scFc | VH CDR2 | VISYEGSNKYYAESVKG |
| 1427 | CD19 97-G1RE-B10 CC x I2C0-scFc | VH CDR3 | DRGTIFGNYGLEV |
| 1428 | CD19 97-G1RE-B10 CC x I2C0-scFc | VL CDR1 | RSSQSLLHKNNFNYLD |
| 1429 | CD19 97-G1RE-B10 CC x I2C0-scFc | VL CDR2 | LGSNRAS |
| 1430 | CD19 97-G1RE-B10 CC x I2C0-scFc | VL CDR3 | MQALQTPFT |
| 1431 | CD19 97-G1RE-B10 CC x I2C0-scFc | VH | QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |

TABLE 35-continued

Sequence table

| SEQ ID NO: | Designation | Format/ Source | Sequence |
|---|---|---|---|
| 1432 | CD19 97-G1RE-B10 CC x I2C0-scFc | VL | DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIK |
| 1433 | CD19 97-G1RE-B10 CC x I2C0-scFc | scFv | DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS |
| 1434 | CD19 97-G1RE-B10 CC x I2C0-scFc | bispecific molecule | DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1435 | CD19 97-G1RE-B10 CC x I2C0-scFc | bispecific HLE molecule | DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1436 | CD19 97-G1RE-B10 CC x I2C0-scFc_delGK | bispecific HLE molecule | DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1437 | CD19 1-C3-B10 CC x I2C0-scFc | VH CDR1 | NYGMH |

TABLE 35-continued

| SEQ ID NO: | Designation | Format/ Source | Sequence |
|---|---|---|---|
| | | | Sequence table |
| 1438 | CD19 1-C3-B10 CC x I2C0-scFc | VH CDR2 | AIGWEGSNKYYAEPVKG |
| 1439 | CD19 1-C3-B10 CC x I2C0-scFc | VH CDR3 | DRGTIFGYYGMDV |
| 1440 | CD19 1-C3-B10 CC x I2C0-scFc | VL CDR1 | RSSQSLLHKNNFNYLD |
| 1441 | CD19 1-C3-B10 CC x I2C0-scFc | VL CDR2 | LGSNRAS |
| 1442 | CD19 1-C3-B10 CC x I2C0-scFc | VL CDR3 | MQALSEPLT |
| 1443 | CD19 1-C3-B10 CC x I2C0-scFc | VH | QVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSS |
| 1444 | CD19 1-C3-B10 CC x I2C0-scFc | VL | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIK |
| 1445 | CD19 1-C3-B10 CC x I2C0-scFc | scFv | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSS |
| 1446 | CD19 1-C3-B10 CC x I2C0-scFc | bispecific molecule | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 1447 | CD19 1-C3-B10 CC x I2C0-scFc | bispecific HLE molecule | DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 35-continued

| SEQ ID NO: | Designation | Format/ Source | Sequence |
|---|---|---|---|
| | | | Sequence table |
| 1448 | CD19 1-C3-B10 CC x I2C0-scFc_delGK | bispecific HLE molecule | DIVMTQSPLSLPVTPGEPASISCRSSQSLLHKNNFNYLDWYLQKPGQS PQLLIYLGSNRASGVPDRFSGSGSGTDFTLKISRVEAEDVGVYYCMQA LSEPLTFACGTKVEIKGGGGSGGGGSGGGGSQVQLVESGGGVVQPG RSLRLSCEASGFIVSNYGMHWVRQAPGKCLEWVAAIGWEGSNKYYA EPVKGRFTISRDKSKNTLSLQMSSLRAEDTALYYCARDRGTIFGYYGM DVWGQGTTVTVSSGGGGSEVQLVESGGGLVQPGGSLKLSCAASGFT FNKYAMNWVRQAPGKGLEWVARIRSKYNNYATYYADSVKDRFTISR DDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGK AALTLSGVQPEDEAEYYCVLWYSNRWVFGGGTKLTVLGGGGDKTHT CPPCPAPELLGGPSVFLFPPKPKDTLMISRTPEVTCVVVDVSHEDPEVK FNWYVDGVEVHNAKTKPCEEQYGSTYRCVSVLTVLHQDWLNGKEYK CKVSNKALPAPIEKTISKAKGQPREPQVYTLPPSREEMTKNQVSLTCLV KGFYPSDIAVEWESNGQPENNYKTTPPVLDSDGSFFLYSKLTVDKSR WQQGNVFSCSVMHEALHNHYTQKSLSLSPGGGGSGGGGSGGGGS GGGGSGGGGSGGGGSDKTHTCPPCPAPELLGGPSVFLFPPKPKDTL MISRTPEVTCWVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK TTPPVLDSDGSFFLYSKLTVDKSRWQQGNVFSCSVMHEALHNHYTQ KSLSLSPGK |
| 1449 | IgG1 hinge | | DKTHTCPPCP |
| 1450 | IgG2 hinge | | ERKCCVECPPCP |
| 1451 | IgG3 hinge | | ELKTPLDTTHTCPRCP |
| 1452 | IgG4 hinge | | ESKYGPPCPSCP |
| 1453 | EGFRvIIIccxI2C-Hinge-CH2-CH3-linker-hinge-CH2-CH3 (DF9) | bispecific HLE molecule | QVQLVESGGGVVQSGRSLRLSCAASGFTFRNYGMHWVRQAPGKCL EWVAVIWYDGSDKYYADSVRGRFTISRDNSKNTLYLQMNSLRAEDTA VYYCARDGYDILTGNPRDFDYWGQGTLVTVSSGGGGSGGGGSGGG GSDTVMTQTPLSSHVTLGQPASISCRSSQSLVHSDGNTYLSWLQQRP GQPPRLLIYRISRRFSGVPDRFSGSGAGTDFTLEISRVEAEDVGVYYCM QSTHVPRTFGCGTKVEIKSGGGGSEVQLVESGGGLVQPGGSLKLSCA ASGFTFNKYAMNWVRQAPGKGLEWVARIRSKYNNYATYYADSVKD RFTISRDDSKNTAYLQMNNLKTEDTAVYYCVRHGNFGNSYISYWAY WGQGTLVTVSSGGGGSGGGGSGGGGSQTVVTQEPSLTVSPGGTVT LTCGSSTGAVTSGNYPNWVQQKPGQAPRGLIGGTKFLAPGTPARFS GSLLGGKAALTLSGVQPEDEAEYYCVLWYSNRWVFGGGTKLTVLGG GGDKTHTCPPCPAPELLGGPSVFLFPPKPKDTLMISRTPEVTCVVVDV SHEDPEVKFNWYVDGVEVHNAKTKPCEEQYGSTYRCVSVLTVLHQD WLNGKEYKCKVSNKALPAPIEKTISKAKGQPREPQVYTLPPSREEMTK NQVSLTCLVKGFYPSDIAVEWESNGQPENNYKTTPPVLDSDGSFFLYS KLTVDKSRWQQGNVFSCSVMHEALHNHYTQKSLSLSPGKGGGGSG GGGSGGGGSGGGGSGGGGSGGGGSDKTHTCPPCPAPELLGGPSVF LFPPKPKDTLMISRTPEVTCVVVDVSHEDPEVKFNWYVDGVEVHNAK TKPCEEQYGSTYRCVSVLTVLHQDWLNGKEYKCKVSNKALPAPIEKTIS KAKGQPREPQVYTLPPSREEMTKNQVSLTCLVKGFYPSDIAVEWESN GQPENNYKTTPPVLDSDGSFFLYSKLTVDKSRWQQGNVFSCSVMHE ALHNHYTQKSLSLSPGK |
| 1454 | EGFRvIIIccxI2C-Hinge-CH2-CH3-linker-CH2-CH3 (T2G) | bispecific HLE molecule | QVQLVESGGGVVQSGRSLRLSCAASGFTFRNYGMHWVRQAPGKCL EWVAVIWYDGSDKYYADSVRGRFTISRDNSKNTLYLQMNSLRAEDTA VYYCARDGYDILTGNPRDFDYWGQGTLVTVSSGGGGSGGGGSGGG GSDTVMTQTPLSSHVTLGQPASISCRSSQSLVHSDGNTYLSWLQQRP GQPPRLLIYRISRRFSGVPDRFSGSGAGTDFTLEISRVEAEDVGVYYCM QSTHVPRTFGCGTKVEIKSGGGGSEVQLVESGGGLVQPGGSLKLSCA ASGFTFNKYAMNWVRQAPGKGLEWVARIRSKYNNYATYYADSVKD RFTISRDDSKNTAYLQMNNLKTEDTAVYYCVRHGNFGNSYISYWAY WGQGTLVTVSSGGGGSGGGGSGGGGSQTVVTQEPSLTVSPGGTVT LTCGSSTGAVTSGNYPNWVQQKPGQAPRGLIGGTKFLAPGTPARFS GSLLGGKAALTLSGVQPEDEAEYYCVLWYSNRWVFGGGTKLTVLGG GGDKTHTCPPCPAPELLGGPSVFLFPPKPKDTLMISRTPEVTCVVVDV SHEDPEVKFNWYVDGVEVHNAKTKPCEEQYGSTYRCVSVLTVLHQD WLNGKEYKCKVSNKALPAPIEKTISKAKGQPREPQVYTLPPSREEMTK NQVSLTCLVKGFYPSDIAVEWESNGQPENNYKTTPPVLDSDGSFFLYS KLTVDKSRWQQGNVFSCSVMHEALHNHYTQKSLSLSPGKGGGGSG GGGSGGGGSGGGGSGGGGSGGGGSAPELLGGPSVFLFPPKPKDTL MISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYK |

TABLE 35-continued

| SEQ ID NO: | Designation | Format/ Source | Sequence |
|---|---|---|---|
| | | | TTPPVLDSDGSFFLYSKLTVDKSRWQQGNVFSCSVMHEALHNHYTQ KSLSLSPGK |
| 1455 | EGFRvIIIccxI2 C- Hinge-CH2-linker-Hinge-CH2-CH3-linker-CH3 (D3L) | bispecific HLE molecule | QVQLVESGGGVVQSGRSLRLSCAASGFTFRNYGMHWVRQAPGKCL EWVAVIWYDGSDKYYADSVRGRFTISRDNSKNTLYLQMNSLRAEDTA VYYCARDGYDILTGNPRDFDYWGQGTLVTVSSGGGGSGGGGSGGG GSDTVMTQTPLSSHVTLGQPASISCRSSQSLVHSDGNTYLSWLQQRP GQPPRLLIYRISRRFSGVPDRFSGSGAGTDFTLEISRVEAEDVGVYYCM QSTHVPRTFGCGTKVEIKSGGGGSEVQLVESGGGLVQPGGSLKLSCA ASGFTFNKYAMNWVRQAPGKGLEWVARIRSKYNNYATYYADSVKD RFTISRDDSKNTAYLQMNNLKTEDTAVYYCVRHGNFGNSYISYWAY WGQGTLVTVSSGGGGSGGGGSGGGGSQTVVTQEPSLTVSPGGTVT LTCGSSTGAVTSGNYPNWVQQKPGQAPRGLIGGTKFLAPGTPARFS GSLLGGKAALTLSGVQPEDEAEYYCVLWYSNRWVFGGGTKLTVLGG GGDKTHTCPPCPAPELLGGPSVFLFPPKPKDTLMISRTPEVTCVVVDV SHEDPEVKFNWYVDGVEVHNAKTKPCEEQYGSTYRCVSVLTVLHQD WLNGKEYKCKVSNKALPAPIEKTISKAKGGGGSGGGGSGGGGSGGG GSDKTHTCPPCPAPELLGGPSVFLFPPKPKDTLMISRTPEVTCVVVDVS HEDPEVKFNWYVDGVEVHNAKTKPCEEQYGSTYRCVSVLTVLHQDW LNGKEYKCKVSNKALPAPIEKTISKAKGQPREPQVYTLPPSREEMTKN QVSLTCLVKGFYPSDIAVEWESNGQPENNYKTTPPVLDSDGSFFLYSK LTVDKSRWQQGNVFSCSVMHEALHNHYTQKSLSLSPGKGGGGSGG GGSGGGGSGGGGSGQPREPQVYTLPPSREEMTKNQVSLTCLVKGFY PSDIAVEWESNGQPENNYKTTPPVLDSDGSFFLYSKLTVDKSRWQQG NVFSCSVMHEALHNHYTQKSLSLSPGK |
| 1456 | EGFRvIIIccxI2 C- Hinge-CH2-linker-CH2-CH3-linker-CH3 (T7I) | bispecific HLE molecule | QVQLVESGGGVVQSGRSLRLSCAASGFTFRNYGMHWVRQAPGKCL EWVAVIWYDGSDKYYADSVRGRFTISRDNSKNTLYLQMNSLRAEDTA VYYCARDGYDILTGNPRDFDYWGQGTLVTVSSGGGGSGGGGSGGG GSDTVMTQTPLSSHVTLGQPASISCRSSQSLVHSDGNTYLSWLQQRP GQPPRLLIYRISRRFSGVPDRFSGSGAGTDFTLEISRVEAEDVGVYYCM QSTHVPRTFGCGTKVEIKSGGGGSEVQLVESGGGLVQPGGSLKLSCA ASGFTFNKYAMNWVRQAPGKGLEWVARIRSKYNNYATYYADSVKD RFTISRDDSKNTAYLQMNNLKTEDTAVYYCVRHGNFGNSYISYWAY WGQGTLVTVSSGGGGSGGGGSGGGGSQTVVTQEPSLTVSPGGTVT LTCGSSTGAVTSGNYPNWVQQKPGQAPRGLIGGTKFLAPGTPARFS GSLLGGKAALTLSGVQPEDEAEYYCVLWYSNRWVFGGGTKLTVLGG GGDKTHTCPPCPAPELLGGPSVFLFPPKPKDTLMISRTPEVTCVVVDV SHEDPEVKFNWYVDGVEVHNAKTKPCEEQYGSTYRCVSVLTVLHQD WLNGKEYKCKVSNKALPAPIEKTISKAKGGGGSGGGGSGGGGSGGG GSAPELLGGPSVFLFPPKPKDTLMISRTPEVTCVVVDVSHEDPEVKFN WYVDGVEVHNAKTKPCEEQYGSTYRCVSVLTVLHQDWLNGKEYKCK VSNKALPAPIEKTISKAKGQPREPQVYTLPPSREEMTKNQVSLTCLVKG FYPSDIAVEWESNGQPENNYKTTPPVLDSDGSFFLYSKLTVDKSRWQ QGNVFSCSVMHEALHNHYTQKSLSLSPGKGGGGSGGGGSGGGGSG GGGSGQPREPQVYTLPPSREEMTKNQVSLTCLVKGFYPSDIAVEWES NGQPENNYKTTPPVLDSDGSFFLYSKLTVDKSRWQQGNVFSCSVMH EALHNHYTQKSLSLSPGK |
| 1457 | EGFRvIIIccxI2 C-CH2-linker-CH2-CH3-linker-CH3 (K6C) | bispecific HLE molecule | QVQLVESGGGVVQSGRSLRLSCAASGFTFRNYGMHWVRQAPGKCL EWVAVIWYDGSDKYYADSVRGRFTISRDNSKNTLYLQMNSLRAEDTA VYYCARDGYDILTGNPRDFDYWGQGTLVTVSSGGGGSGGGGSGGG GSDTVMTQTPLSSHVTLGQPASISCRSSQSLVHSDGNTYLSWLQQRP GQPPRLLIYRISRRFSGVPDRFSGSGAGTDFTLEISRVEAEDVGVYYCM QSTHVPRTFGCGTKVEIKSGGGGSEVQLVESGGGLVQPGGSLKLSCA ASGFTFNKYAMNWVRQAPGKGLEWVARIRSKYNNYATYYADSVKD RFTISRDDSKNTAYLQMNNLKTEDTAVYYCVRHGNFGNSYISYWAY WGQGTLVTVSSGGGGSGGGGSGGGGSQTVVTQEPSLTVSPGGTVT LTCGSSTGAVTSGNYPNWVQQKPGQAPRGLIGGTKFLAPGTPARFS GSLLGGKAALTLSGVQPEDEAEYYCVLWYSNRWVFGGGTKLTVLGG GGAPELLGGPSVFLFPPKPKDTLMISRTPEVTCVVVDVSHEDPEVKFN WYVDGVEVHNAKTKPCEEQYGSTYRCVSVLTVLHQDWLNGKEYKCK VSNKALPAPIEKTISKAKGGGGSGGGGSGGGGSGGGGSAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWE SNGQPENNYKTTPPVLDSDGSFFLYSKLTVDKSRWQQGNVFSCSVM HEALHNHYTQKSLSLSPGKGGGGSGGGGSGGGGSGGGGSGQPREP QVYTLPPSREEMTKNQVSLTCLVKGFYPSDIAVEWESNGQPENNYKT TPPVLDSDGSFFLYSKLTVDKSRWQQGNVFSCSVMHEALHNHYTQK SLSLSPGK |

TABLE 35-continued

Sequence table

| SEQ ID NO: | Designation | Format/ Source | Sequence |
|---|---|---|---|
| 1458 | IgG3 hinge | | ELKTPLGDTTHTCPRCP |
| 1459 | IgG1 hinge | | EPKSCDKTHTCPPCP |

SEQUENCE LISTING (1558 sequences)

SEQ ID NO: 1 - protein, 5 aa, synthetic construct
  REGION 1..5: note = Synthetic peptide
GGGGS

SEQ ID NO: 2 - protein, 10 aa, synthetic construct
  REGION 1..10: note = Synthetic peptide
GGGGSGGGGS

SEQ ID NO: 3 - protein, 15 aa, synthetic construct
  REGION 1..15: note = Synthetic peptide
GGGGSGGGGSGGGGS

SEQ ID NO: 4 - protein, 20 aa, synthetic construct
  REGION 1..20: note = Synthetic peptide
GGGGSGGGGSGGGGSGGGGS

SEQ ID NO: 5 - protein, 25 aa, synthetic construct
  REGION 1..25: note = Synthetic peptide
GGGGSGGGGSGGGGSGGGGSGGGGS

SEQ ID NO: 6 - protein, 30 aa, synthetic construct
  REGION 1..30: note = Synthetic peptide
GGGGSGGGGSGGGGSGGGGSGGGGSGGGGS

SEQ ID NO: 7 - protein, 35 aa, synthetic construct
  REGION 1..35: note = Synthetic peptide
GGGGSGGGGSGGGGSGGGGSGGGGSGGGGSGGGGS

SEQ ID NO: 8 - protein, 40 aa, synthetic construct
  REGION 1..40: note = Synthetic peptide
GGGGSGGGGSGGGGSGGGGSGGGGSGGGGSGGGGSGGGGS

SEQ ID NO: 9 - protein, 6 aa, synthetic construct
  REGION 1..6: note = Synthetic peptide
PGGGGS

SEQ ID NO: 10 - protein, 6 aa, synthetic construct
  REGION 1..6: note = Synthetic peptide
PGGDGS

SEQ ID NO: 11 - protein, 6 aa, synthetic construct
  REGION 1..6: note = Synthetic peptide
SGGGGS

SEQ ID NO: 12 - protein, 4 aa, synthetic construct
  REGION 1..4: note = Synthetic peptide
GGGG

SEQ ID NO: 13 - protein, 109 aa, synthetic construct
  REGION 1..109: note = Synthetic peptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 14 - protein, 125 aa, synthetic construct
  REGION 1..125: note = Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 15 - protein, 249 aa, synthetic construct
  REGION 1..249: note = Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 16 - protein, 6 aa, synthetic construct
  REGION 1..6: note = Synthetic peptide
HHHHHH

SEQ ID NO: 17 - protein, 227 aa, synthetic construct
  REGION 1..227: note = Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 225 aa, synthetic construct
  REGION 1..225: note = Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 19 - protein, 227 aa, synthetic construct
  REGION 1..227: note = Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 225 aa, synthetic construct
  REGION 1..225: note = Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 21 - protein, 227 aa, synthetic construct
  REGION 1..227: note = Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 225 aa, synthetic construct
  REGION 1..225: note = Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 23 - protein, 227 aa, synthetic construct
  REGION 1..227: note = Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 225 aa, synthetic construct
  REGION 1..225: note = Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25 - protein, 484 aa, synthetic construct
  REGION 1..484: note = Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 480 aa, synthetic construct
  REGION 1..480: note = Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 27 - protein, 484 aa, synthetic construct
  REGION 1..484: note = Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 480 aa, synthetic construct
  REGION 1..480: note = Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 29 - protein, 484 aa, synthetic construct
  REGION 1..484: note = Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 480 aa, synthetic construct
  REGION 1..480: note = Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 31 - protein, 484 aa, synthetic construct
  REGION 1..484: note = Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 480 aa, synthetic construct
  REGION 1..480: note = Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 33 - protein, 725 aa, synthetic construct
  REGION 1..725: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 34 - protein, 227 aa, synthetic construct
  REGION 1..227: note = Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 35 - protein, 1091 aa, synthetic construct
  REGION 1..1091: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 36 - protein, 571 aa, synthetic construct
  REGION 1..571: note = Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 37 - protein, 577 aa, synthetic construct
  REGION 1..577: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 38 - protein, 732 aa, synthetic construct
  REGION 1..732: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 39 - protein, 227 aa, synthetic construct; identical to SEQ ID NO: 34
  REGION 1..227: note = Synthetic peptide

SEQ ID NO: 40 - protein, 736 aa, synthetic construct
  REGION 1..736: note = Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 41 - protein, 227 aa, synthetic construct; identical to SEQ ID NO: 34
  REGION 1..227: note = Synthetic peptide

SEQ ID NO: 42 - protein, 993 aa, synthetic construct
  REGION 1..993: note = Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 989 aa, synthetic construct
  REGION 1..989: note = Synthetic peptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 5 aa, synthetic construct
  REGION 1..5: note = Synthetic peptide
NYGMN

SEQ ID NO: 45 - protein, 17 aa, synthetic construct
  REGION 1..17: note = Synthetic peptide
WINTYTGEPTYADKFQG

SEQ ID NO: 46 - protein, 13 aa, synthetic construct
  REGION 1..13: note = Synthetic peptide
WSWSDGYYVYFDY

SEQ ID NO: 47 - protein, 17 aa, synthetic construct
  REGION 1..17: note = Synthetic peptide
KSSQSVLDSSTNKNSLA

SEQ ID NO: 48 - protein, 7 aa, synthetic construct
  REGION 1..7: note = Synthetic peptide
WASTRES

SEQ ID NO: 49 - protein, 9 aa, synthetic construct
  REGION 1..9: note = Synthetic peptide
QQSAHFPIT

SEQ ID NO: 50 - protein, 122 aa, synthetic construct
  REGION 1..122: note = Synthetic peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSS

SEQ ID NO: 51 - protein, 113 aa, synthetic construct
  REGION 1..113: note = Synthetic peptide
DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK

SEQ ID NO: 52 - protein, 250 aa, synthetic construct
  REGION 1..250: note = Synthetic peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK

SEQ ID NO: 53 - protein, 505 aa, synthetic construct
  REGION 1..505: note = Synthetic peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 54 - protein, 993 aa, synthetic construct
  REGION 1..993: note = Synthetic peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 991 aa, synthetic construct
  REGION 1..991: note = Synthetic peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 122 aa, synthetic construct
  REGION 1..122: note = Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSS

SEQ ID NO: 57 - protein, 113 aa, synthetic construct
  REGION 1..113: note = Synthetic peptide
DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIK

SEQ ID NO: 58 - protein, 250 aa, synthetic construct
  REGION 1..250: note = Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIK

SEQ ID NO: 59 - protein, 505 aa, synthetic construct
  REGION 1..505: note = Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 60 - protein, 993 aa, synthetic construct; identical to SEQ ID NO: 42
  REGION 1..993: note = Synthetic peptide

SEQ ID NO: 61 - protein, 991 aa, synthetic construct
  REGION 1..991: note = Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 5 aa, synthetic construct
  REGION 1..5: note = Synthetic peptide
NYGMH

SEQ ID NO: 63 - protein, 17 aa, synthetic construct
  REGION 1..17: note = Synthetic peptide
VIWYDGSDKYYADSVRG

SEQ ID NO: 64 - protein, 15 aa, synthetic construct
  REGION 1..15: note = Synthetic peptide
DGYDILTGNPRDFDY

SEQ ID NO: 65 - protein, 16 aa, synthetic construct
  REGION 1..16: note = Synthetic peptide
RSSQSLVHSDGNTYLS

SEQ ID NO: 66 - protein, 7 aa, synthetic construct
  REGION 1..7: note = Synthetic peptide
RISRRFS

SEQ ID NO: 67 - protein, 9 aa, synthetic construct
  REGION 1..9: note = Synthetic peptide
MQSTHVPRT

SEQ ID NO: 68 - protein, 124 aa, synthetic construct
  REGION 1..124: note = Synthetic peptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 69 - protein, 112 aa, synthetic construct
  REGION 1..112: note = Synthetic peptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 70 - protein, 251 aa, synthetic construct
  REGION 1..251: note = Synthetic peptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 71 - protein, 506 aa, synthetic construct
  REGION 1..506: note = Synthetic peptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 72 - protein, 994 aa, synthetic construct
  REGION 1..994: note = Synthetic peptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 992 aa, synthetic construct
  REGION 1..992: note = Synthetic peptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 124 aa, synthetic construct
  REGION 1..124: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSS

SEQ ID NO: 75 - protein, 112 aa, synthetic construct
  REGION 1..112: note = Synthetic peptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIK

SEQ ID NO: 76 - protein, 251 aa, synthetic construct
  REGION 1..251: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIK

SEQ ID NO: 77 - protein, 506 aa, synthetic construct
  REGION 1..506: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 78 - protein, 994 aa, synthetic construct
  REGION 1..994: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 992 aa, synthetic construct
  REGION 1..992: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 5 aa, synthetic construct
  REGION 1..5: note = Synthetic peptide
DYYMT

SEQ ID NO: 81 - protein, 17 aa, synthetic construct
  REGION 1..17: note = Synthetic peptide
YISSSGSTIYYADSVKG

SEQ ID NO: 82 - protein, 8 aa, synthetic construct
  REGION 1..8: note = Synthetic peptide
DRNSHFDY

SEQ ID NO: 83 - protein, 11 aa, synthetic construct
  REGION 1..11: note = Synthetic peptide
RASQGINTWLA

SEQ ID NO: 84 - protein, 7 aa, synthetic construct
  REGION 1..7: note = Synthetic peptide
GASGLQS

SEQ ID NO: 85 - protein, 9 aa, synthetic construct
  REGION 1..9: note = Synthetic peptide
QQAKSFPRT

SEQ ID NO: 86 - protein, 117 aa, synthetic construct
  REGION 1..117: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSS

SEQ ID NO: 87 - protein, 107 aa, synthetic construct
  REGION 1..107: note = Synthetic peptide
DIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 88 - protein, 239 aa, synthetic construct
  REGION 1..239: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 89 - protein, 494 aa, synthetic construct
  REGION 1..494: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 90 - protein, 982 aa, synthetic construct
  REGION 1..982: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 980 aa, synthetic construct
  REGION 1..980: note = Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 117 aa, synthetic construct
  REGION 1..117: note = Synthetic peptide
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSS

SEQ ID NO: 93 - protein, 107 aa, synthetic construct
  REGION 1..107: note = Synthetic peptide
DIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIK

SEQ ID NO: 94 - protein, 239 aa, synthetic construct
  REGION 1..239: note = Synthetic peptide
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIK

SEQ ID NO: 95 - protein, 494 aa, synthetic construct
  REGION 1..494: note = Synthetic peptide
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 96 - protein, 982 aa, synthetic construct
  REGION 1..982: note = Synthetic peptide
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 980 aa, synthetic construct
  REGION 1..980: note = Synthetic peptide
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 5 aa, synthetic construct
  REGION 1..5: note = Synthetic peptide
DYYMT

SEQ ID NO: 99 - protein, 17 aa, synthetic construct
  REGION 1..17: note = Synthetic peptide
YISSSGSTIYYADSVKG

SEQ ID NO: 100 - protein, 8 aa, synthetic construct
  REGION 1..8: note = Synthetic peptide
DRNSHFDY

SEQ ID NO: 101 - protein, 11 aa, synthetic construct
  REGION 1..11: note = Synthetic peptide
RASQGITRWLA

SEQ ID NO: 102 - protein, 7 aa, synthetic construct
  REGION 1..7: note = Synthetic peptide
AASVLQS

SEQ ID NO: 103 - protein, 9 aa, synthetic construct
  REGION 1..9: note = Synthetic peptide
QQSNSFPRT

SEQ ID NO: 104 - protein, 117 aa, synthetic construct
  REGION 1..117: note = Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSS

SEQ ID NO: 105 - protein, 107 aa, synthetic construct
  REGION 1..107: note = Synthetic peptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 106 - protein, 239 aa, synthetic construct
  REGION 1..239: note = Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 107 - protein, 494 aa, synthetic construct
  REGION 1..494: note = Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 108 - protein, 982 aa, synthetic construct
  REGION 1..982: note = Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 980 aa, synthetic construct
  REGION 1..980: note = Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 117 aa, synthetic construct
  REGION 1..117: note = Synthetic peptide
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSS

SEQ ID NO: 111 - protein, 107 aa, synthetic construct
  REGION 1..107: note = Synthetic peptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIK

SEQ ID NO: 112 - protein, 239 aa, synthetic construct
  REGION 1..239: note = Synthetic peptide
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIK

SEQ ID NO: 113 - protein, 494 aa, synthetic construct
  REGION 1..494: note = Synthetic peptide
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 114 - protein, 982 aa, synthetic construct
  REGION 1..982: note = Synthetic peptide
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 980 aa, synthetic construct
  REGION 1..980: note = Synthetic peptide
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 5 aa, synthetic construct
  REGION 1..5: note = Synthetic peptide
DHYMS

SEQ ID NO: 117 - protein, 17 aa, synthetic construct
  REGION 1..17: note = Synthetic peptide
YISSSGGIIYYADSVKG

SEQ ID NO: 118 - protein, 8 aa, synthetic construct
  REGION 1..8: note = Synthetic peptide
DVGSHFDY

SEQ ID NO: 119 - protein, 11 aa, synthetic construct
  REGION 1..11: note = Synthetic peptide
RASQDISRWLA

SEQ ID NO: 120 - protein, 7 aa, synthetic construct
  REGION 1..7: note = Synthetic peptide
AASRLQS

SEQ ID NO: 121 - protein, 9 aa, synthetic construct
  REGION 1..9: note = Synthetic peptide
QQAKSFPRT

SEQ ID NO: 122 - protein, 117 aa, synthetic construct
  REGION 1..117: note = Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSS

SEQ ID NO: 123 - protein, 107 aa, synthetic construct
  REGION 1..107: note = Synthetic peptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 124 - protein, 239 aa, synthetic construct
  REGION 1..239: note = Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 125 - protein, 494 aa, synthetic construct
  REGION 1..494: note = Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 126 - protein, 982 aa, synthetic construct
  REGION 1..982: note = Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 980 aa, synthetic construct
  REGION 1..980: note = Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 117 aa, synthetic construct
  REGION 1..117: note = Synthetic peptide
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSS

SEQ ID NO: 129 - protein, 107 aa, synthetic construct
  REGION 1..107: note = Synthetic peptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIK

SEQ ID NO: 130 - protein, 239 aa, synthetic construct
  REGION 1..239: note = Synthetic peptide
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIK

SEQ ID NO: 131 - protein, 494 aa, synthetic construct
  REGION 1..494: note = Synthetic peptide
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 132 - protein, 982 aa, synthetic construct
  REGION 1..982: note = Synthetic peptide
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 980 aa, synthetic construct
  REGION 1..980: note = Synthetic peptide
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 5 aa, synthetic construct
  REGION 1..5: note = Synthetic peptide
SYGMH

SEQ ID NO: 135 - protein, 17 aa, synthetic construct
  REGION 1..17: note = Synthetic peptide
FIWYDGSNKYYADSVKD

SEQ ID NO: 136 - protein, 16 aa, synthetic construct
  REGION 1..16: note = Synthetic peptide
RAGIIGTIGYYYGMDV

SEQ ID NO: 137 - protein, 11 aa, synthetic construct
  REGION 1..11: note = Synthetic peptide
SGDRLGEKYTS

SEQ ID NO: 138 - protein, 7 aa, synthetic construct
  REGION 1..7: note = Synthetic peptide
QDTKRPS

SEQ ID NO: 139 - protein, 9 aa, synthetic construct
  REGION 1..9: note = Synthetic peptide
QAWESSTVV

SEQ ID NO: 140 - protein, 125 aa, synthetic construct
  REGION 1..125: note = Synthetic peptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSS

SEQ ID NO: 141 - protein, 106 aa, synthetic construct
  REGION 1..106: note = Synthetic peptide
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 142 - protein, 246 aa, synthetic construct
  REGION 1..246: note = Synthetic peptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 143 - protein, 501 aa, synthetic construct
  REGION 1..501: note = Synthetic peptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 144 - protein, 989 aa, synthetic construct
  REGION 1..989: note = Synthetic peptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 987 aa, synthetic construct
  REGION 1..987: note = Synthetic peptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 146 - protein, 125 aa, synthetic construct
  REGION 1..125: note = Synthetic peptide
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSS

SEQ ID NO: 147 - protein, 106 aa, synthetic construct
  REGION 1..106: note = Synthetic peptide
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 148 - protein, 246 aa, synthetic construct
  REGION 1..246: note = Synthetic peptide
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 149 - protein, 501 aa, synthetic construct
  REGION 1..501: note = Synthetic peptide
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 150 - protein, 989 aa, synthetic construct
  REGION 1..989: note = Synthetic peptide
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 987 aa, synthetic construct
  REGION 1..987: note = Synthetic peptide
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 5 aa, synthetic construct
  REGION 1..5: note = Synthetic peptide
SYGMH

SEQ ID NO: 153 - protein, 17 aa, synthetic construct
  REGION 1..17: note = Synthetic peptide
FIWYDGSNKYYADSVKG

SEQ ID NO: 154 - protein, 16 aa, synthetic construct
  REGION 1..16: note = Synthetic peptide
RAGIIGTIGYYYGMDV

SEQ ID NO: 155 - protein, 11 aa, synthetic construct
  REGION 1..11: note = Synthetic peptide
SGDRLGEKYTS

SEQ ID NO: 156 - protein, 7 aa, synthetic construct
  REGION 1..7: note = Synthetic peptide
QDTKRPS

SEQ ID NO: 157 - protein, 9 aa, synthetic construct
  REGION 1..9: note = Synthetic peptide
QAWESSTVV

SEQ ID NO: 158 - protein, 125 aa, synthetic construct
  REGION 1..125: note = Synthetic peptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSS

SEQ ID NO: 159 - protein, 106 aa, synthetic construct; identical to SEQ ID NO: 141
  REGION 1..106: note = Synthetic peptide

SEQ ID NO: 160 - protein, 246 aa, synthetic construct
  REGION 1..246: note = Synthetic peptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 161 - protein, 501 aa, synthetic construct
  REGION 1..501: note = Synthetic peptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 162 - protein, 989 aa, synthetic construct
  REGION 1..989: note = Synthetic peptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 987 aa, synthetic construct
  REGION 1..987: note = Synthetic peptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 125 aa, synthetic construct
  REGION 1..125: note = Synthetic peptide
QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSS

SEQ ID NO: 165 - protein, 106 aa, synthetic construct; identical to SEQ ID NO: 147
  REGION 1..106: note = Synthetic peptide

SEQ ID NO: 166 - protein, 246 aa, synthetic construct
  REGION 1..246: note = Synthetic peptide
QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 167 - protein, 501 aa, synthetic construct
  REGION 1..501: note = Synthetic peptide
QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 168 - protein, 989 aa, synthetic construct
  REGION 1..989: note = Synthetic peptide
QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 987 aa, synthetic construct
  REGION 1..987: note = Synthetic peptide
QVQLVESGGGVVQPGGSLRLSCAASGFTFSSYGMHWVRQAPGKCLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 5 aa, synthetic construct
  REGION 1..5: note = Synthetic peptide
SYGMH

SEQ ID NO: 171 - protein, 17 aa, synthetic construct
  REGION 1..17: note = Synthetic peptide
FIWYEGSNKYYAESVKD

SEQ ID NO: 172 - protein, 16 aa, synthetic construct
  REGION 1..16: note = Synthetic peptide
RAGIIGTIGYYYGMDV

SEQ ID NO: 173 - protein, 11 aa, synthetic construct
  REGION 1..11: note = Synthetic peptide
SGDRLGEKYTS

SEQ ID NO: 174 - protein, 7 aa, synthetic construct
  REGION 1..7: note = Synthetic peptide
QDTKRPS

SEQ ID NO: 175 - protein, 9 aa, synthetic construct
  REGION 1..9: note = Synthetic peptide
QAWESSTVV

SEQ ID NO: 176 - protein, 125 aa, synthetic construct
  REGION 1..125: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSS

SEQ ID NO: 177 - protein, 106 aa, synthetic construct; identical to SEQ ID NO: 141
  REGION 1..106: note = Synthetic peptide

SEQ ID NO: 178 - protein, 246 aa, synthetic construct
  REGION 1..246: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 179 - protein, 501 aa, synthetic construct
  REGION 1..501: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 180 - protein, 989 aa, synthetic construct
  REGION 1..989: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 987 aa, synthetic construct
  REGION 1..987: note = Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 125 aa, synthetic construct
  REGION 1..125: note = Synthetic peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSS

SEQ ID NO: 183 - protein, 106 aa, synthetic construct; identical to SEQ ID NO: 147
  REGION 1..106: note = Synthetic peptide

SEQ ID NO: 184 - protein, 246 aa, synthetic construct
  REGION 1..246: note = Synthetic peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 185 - protein, 501 aa, synthetic construct
  REGION 1..501: note = Synthetic peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 186 - protein, 989 aa, synthetic construct
  REGION 1..989: note = Synthetic peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 987 aa, synthetic construct
  REGION 1..987: note = Synthetic peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 5 aa, synthetic construct
  REGION 1..5: note = Synthetic peptide
SYYWS

SEQ ID NO: 189 - protein, 16 aa, synthetic construct
  REGION 1..16: note = Synthetic peptide
YVYYSGTTNYNPSLKS

SEQ ID NO: 190 - protein, 10 aa, synthetic construct
  REGION 1..10: note = Synthetic peptide
IAVTGFYFDY

SEQ ID NO: 191 - protein, 12 aa, synthetic construct
  REGION 1..12: note = Synthetic peptide
RASQRVNNNYLA

SEQ ID NO: 192 - protein, 7 aa, synthetic construct
  REGION 1..7: note = Synthetic peptide
GASSRAT

SEQ ID NO: 193 - protein, 9 aa, synthetic construct
  REGION 1..9: note = Synthetic peptide
QQYDRSPLT

SEQ ID NO: 194 - protein, 118 aa, synthetic construct
  REGION 1..118: note = Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSS

SEQ ID NO: 195 - protein, 108 aa, synthetic construct
  REGION 1..108: note = Synthetic peptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 196 - protein, 241 aa, synthetic construct
  REGION 1..241: note = Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 197 - protein, 496 aa, synthetic construct
  REGION 1..496: note = Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 198 - protein, 984 aa, synthetic construct
  REGION 1..984: note = Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 982 aa, synthetic construct
  REGION 1..982: note = Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 118 aa, synthetic construct
  REGION 1..118: note = Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSS

SEQ ID NO: 201 - protein, 108 aa, synthetic construct
  REGION 1..108: note = Synthetic peptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIK

SEQ ID NO: 202 - protein, 241 aa, synthetic construct
  REGION 1..241: note = Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIK

SEQ ID NO: 203 - protein, 496 aa, synthetic construct
  REGION 1..496: note = Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 204 - protein, 984 aa, synthetic construct
  REGION 1..984: note = Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 982 aa, synthetic construct
  REGION 1..982: note = Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 5 aa, synthetic construct
  REGION 1..5: note = Synthetic peptide
SFYWS

SEQ ID NO: 207 - protein, 16 aa, synthetic construct
  REGION 1..16: note = Synthetic peptide
YIYYSGTTNYNPSLKS

SEQ ID NO: 208 - protein, 10 aa, synthetic construct
  REGION 1..10: note = Synthetic peptide
IAVAGFFFDY

SEQ ID NO: 209 - protein, 12 aa, synthetic construct
  REGION 1..12: note = Synthetic peptide
RASQSVNKNYLA

SEQ ID NO: 210 - protein, 7 aa, synthetic construct
  REGION 1..7: note = Synthetic peptide
GASSRAT

SEQ ID NO: 211 - protein, 9 aa, synthetic construct
  REGION 1..9: note = Synthetic peptide
QQYDRSPLT

SEQ ID NO: 212 - protein, 118 aa, synthetic construct
  REGION 1..118: note = Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSS

SEQ ID NO: 213 - protein, 108 aa, synthetic construct
  REGION 1..108: note = Synthetic peptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 214 - protein, 241 aa, synthetic construct
  REGION 1..241: note = Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 215 - protein, 496 aa, synthetic construct
  REGION 1..496: note = Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 216 - protein, 984 aa, synthetic construct
  REGION 1..984: note = Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - protein, 982 aa, synthetic construct
  REGION 1..982: note = Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 118 aa, synthetic construct
  REGION 1..118: note = Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSS

SEQ ID NO: 219 - protein, 108 aa, synthetic construct
  REGION 1..108: note = Synthetic peptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIK

SEQ ID NO: 220 - protein, 241 aa, synthetic construct
  REGION 1..241: note = Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIK

SEQ ID NO: 221 - protein, 496 aa, synthetic construct
  REGION 1..496: note = Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 222 - protein, 984 aa, synthetic construct
  REGION 1..984: note = Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 982 aa, synthetic construct
  REGION 1..982: note = Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - protein, 5 aa, synthetic construct
  REGION 1..5: note = Synthetic peptide
NYYMH

SEQ ID NO: 225 - protein, 17 aa, synthetic construct
  REGION 1..17: note = Synthetic peptide
IINPSDGSTSYAQKFQG

SEQ ID NO: 226 - protein, 14 aa, synthetic construct
  REGION 1..14: note = Synthetic peptide
GGNSAFYSYYDMDV

SEQ ID NO: 227 - protein, 16 aa, synthetic construct
  REGION 1..16: note = Synthetic peptide
RSSQSLVYRDGNTYLS

SEQ ID NO: 228 - protein, 7 aa, synthetic construct
  REGION 1..7: note = Synthetic peptide
KVSNWQS

SEQ ID NO: 229 - protein, 9 aa, synthetic construct
  REGION 1..9: note = Synthetic peptide
MQGTHWPPT

SEQ ID NO: 230 - protein, 123 aa, synthetic construct
  REGION 1..123: note = Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSS

SEQ ID NO: 231 - protein, 112 aa, synthetic construct
  REGION 1..112: note = Synthetic peptide
DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 232 - protein, 250 aa, synthetic construct
  REGION 1..250: note = Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 233 - protein, 505 aa, synthetic construct
  REGION 1..505: note = Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 234 - protein, 993 aa, synthetic construct
  REGION 1..993: note = Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 991 aa, synthetic construct
  REGION 1..991: note = Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - protein, 123 aa, synthetic construct
  REGION 1..123: note = Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSS

SEQ ID NO: 237 - protein, 112 aa, synthetic construct
  REGION 1..112: note = Synthetic peptide
DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 238 - protein, 250 aa, synthetic construct
  REGION 1..250: note = Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 239 - protein, 505 aa, synthetic construct
  REGION 1..505: note = Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 240 - protein, 993 aa, synthetic construct
  REGION 1..993: note = Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 991 aa, synthetic construct
  REGION 1..991: note = Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 5 aa, synthetic construct
  REGION 1..5: note = Synthetic peptide
SYGVS

SEQ ID NO: 243 - protein, 17 aa, synthetic construct
  REGION 1..17: note = Synthetic peptide
YNDPVFGSIYYASWVKG

SEQ ID NO: 244 - protein, 14 aa, synthetic construct
  REGION 1..14: note = Synthetic peptide
DRSYVSSSGYHFNL

SEQ ID NO: 245 - protein, 11 aa, synthetic construct
  REGION 1..11: note = Synthetic peptide
QASETIYSSLA

SEQ ID NO: 246 - protein, 7 aa, synthetic construct
  REGION 1..7: note = Synthetic peptide
GASNLES

SEQ ID NO: 247 - protein, 10 aa, synthetic construct
  REGION 1..10: note = Synthetic peptide
QSGVYSAGLT

SEQ ID NO: 248 - protein, 123 aa, synthetic construct
  REGION 1..123: note = Synthetic peptide
EVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 249 - protein, 108 aa, synthetic construct
  REGION 1..108: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIK

SEQ ID NO: 250 - protein, 246 aa, synthetic construct
  REGION 1..246: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 251 - protein, 500 aa, synthetic construct
  REGION 1..500: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 252 - protein, 988 aa, synthetic construct
  REGION 1..988: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 123 aa, synthetic construct
  REGION 1..123: note = Synthetic peptide
EVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 254 - protein, 108 aa, synthetic construct
  REGION 1..108: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIK

SEQ ID NO: 255 - protein, 246 aa, synthetic construct
  REGION 1..246: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 256 - protein, 500 aa, synthetic construct
  REGION 1..500: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 257 - protein, 988 aa, synthetic construct
  REGION 1..988: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 5 aa, synthetic construct
  REGION 1..5: note = Synthetic peptide
SYGVS

SEQ ID NO: 259 - protein, 17 aa, synthetic construct
  REGION 1..17: note = Synthetic peptide
YNDPVFGSIYYASWVKG

SEQ ID NO: 260 - protein, 14 aa, synthetic construct
  REGION 1..14: note = Synthetic peptide
DRSYVSSSGYHFNL

SEQ ID NO: 261 - protein, 11 aa, synthetic construct
  REGION 1..11: note = Synthetic peptide
QASETIYSSLA

SEQ ID NO: 262 - protein, 7 aa, synthetic construct
  REGION 1..7: note = Synthetic peptide
GASNLES

SEQ ID NO: 263 - protein, 10 aa, synthetic construct
  REGION 1..10: note = Synthetic peptide
QSGVYSAGLT

SEQ ID NO: 264 - protein, 123 aa, synthetic construct; identical to SEQ ID NO: 248
  REGION 1..123: note = Synthetic peptide

SEQ ID NO: 265 - protein, 108 aa, synthetic construct
  REGION 1..108: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIK

SEQ ID NO: 266 - protein, 246 aa, synthetic construct
  REGION 1..246: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 267 - protein, 500 aa, synthetic construct
  REGION 1..500: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 268 - protein, 988 aa, synthetic construct
  REGION 1..988: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - protein, 123 aa, synthetic construct; identical to SEQ ID NO: 253
  REGION 1..123: note = Synthetic peptide

SEQ ID NO: 270 - protein, 108 aa, synthetic construct
  REGION 1..108: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIK

SEQ ID NO: 271 - protein, 246 aa, synthetic construct
  REGION 1..246: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 272 - protein, 500 aa, synthetic construct
  REGION 1..500: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 273 - protein, 988 aa, synthetic construct
  REGION 1..988: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - protein, 5 aa, synthetic construct
  REGION 1..5: note = Synthetic peptide
SYGVS

SEQ ID NO: 275 - protein, 17 aa, synthetic construct
  REGION 1..17: note = Synthetic peptide
YNDPVFGSIYYASWVKG

SEQ ID NO: 276 - protein, 14 aa, synthetic construct
  REGION 1..14: note = Synthetic peptide
DRSYVSSSGYHFNL

SEQ ID NO: 277 - protein, 11 aa, synthetic construct
  REGION 1..11: note = Synthetic peptide
QASETIYSSLA

SEQ ID NO: 278 - protein, 7 aa, synthetic construct
  REGION 1..7: note = Synthetic peptide
GASNLES

SEQ ID NO: 279 - protein, 10 aa, synthetic construct
  REGION 1..10: note = Synthetic peptide
QSGVYSAGLT

SEQ ID NO: 280 - protein, 123 aa, synthetic construct; identical to SEQ ID NO: 248
  REGION 1..123: note = Synthetic peptide

SEQ ID NO: 281 - protein, 108 aa, synthetic construct
  REGION 1..108: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIK

SEQ ID NO: 282 - protein, 246 aa, synthetic construct
  REGION 1..246: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 283 - protein, 500 aa, synthetic construct
  REGION 1..500: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 284 - protein, 988 aa, synthetic construct
  REGION 1..988: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 123 aa, synthetic construct; identical to SEQ ID NO: 253
  REGION 1..123: note = Synthetic peptide

SEQ ID NO: 286 - protein, 108 aa, synthetic construct
  REGION 1..108: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIK

SEQ ID NO: 287 - protein, 246 aa, synthetic construct
  REGION 1..246: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 288 - protein, 500 aa, synthetic construct
  REGION 1..500: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 289 - protein, 988 aa, synthetic construct
  REGION 1..988: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 5 aa, synthetic construct
  REGION 1..5: note = Synthetic peptide
SYGVS

SEQ ID NO: 291 - protein, 17 aa, synthetic construct
  REGION 1..17: note = Synthetic peptide
YNDPVFGSIYYASWVKG

SEQ ID NO: 292 - protein, 14 aa, synthetic construct
  REGION 1..14: note = Synthetic peptide
DRSYVSSSGYHFNL

SEQ ID NO: 293 - protein, 11 aa, synthetic construct
  REGION 1..11: note = Synthetic peptide
QASETIYSSLA

SEQ ID NO: 294 - protein, 7 aa, synthetic construct
  REGION 1..7: note = Synthetic peptide
GASNLES

SEQ ID NO: 295 - protein, 10 aa, synthetic construct
  REGION 1..10: note = Synthetic peptide
QSGVYSAGLT

SEQ ID NO: 296 - protein, 123 aa, synthetic construct
  REGION 1..123: note = Synthetic peptide
EVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSS

SEQ ID NO: 297 - protein, 108 aa, synthetic construct
  REGION 1..108: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIK

SEQ ID NO: 298 - protein, 246 aa, synthetic construct
  REGION 1..246: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSS

SEQ ID NO: 299 - protein, 500 aa, synthetic construct
  REGION 1..500: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 300 - protein, 988 aa, synthetic construct
  REGION 1..988: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 123 aa, synthetic construct
  REGION 1..123: note = Synthetic peptide
EVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSS

SEQ ID NO: 302 - protein, 108 aa, synthetic construct
  REGION 1..108: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIK

SEQ ID NO: 303 - protein, 246 aa, synthetic construct
  REGION 1..246: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSS

SEQ ID NO: 304 - protein, 500 aa, synthetic construct
  REGION 1..500: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 305 - protein, 988 aa, synthetic construct
  REGION 1..988: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 986 aa, synthetic construct
  REGION 1..986: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 986 aa, synthetic construct
  REGION 1..986: note = Synthetic peptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - protein, 986 aa, synthetic construct
  REGION 1..986: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - protein, 986 aa, synthetic construct
  REGION 1..986: note = Synthetic peptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 310 - protein, 986 aa, synthetic construct
  REGION 1..986: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 986 aa, synthetic construct
  REGION 1..986: note = Synthetic peptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 986 aa, synthetic construct
  REGION 1..986: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 986 aa, synthetic construct
  REGION 1..986: note = Synthetic peptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 7 aa, synthetic construct
  REGION 1..7: note = Synthetic peptide
NARMGVS

SEQ ID NO: 315 - protein, 16 aa, synthetic construct
  REGION 1..16: note = Synthetic peptide
NIFSNDEKSYSTSLKS

SEQ ID NO: 316 - protein, 14 aa, synthetic construct
  REGION 1..14: note = Synthetic peptide
IVGYGSGWYGYFDY

SEQ ID NO: 317 - protein, 11 aa, synthetic construct
  REGION 1..11: note = Synthetic peptide
RASQGIRNDLG

SEQ ID NO: 318 - protein, 7 aa, synthetic construct
  REGION 1..7: note = Synthetic peptide
AASSLQS

SEQ ID NO: 319 - protein, 9 aa, synthetic construct
  REGION 1..9: note = Synthetic peptide
LQHNSYPLT

SEQ ID NO: 320 - protein, 124 aa, synthetic construct
  REGION 1..124: note = Synthetic peptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSS

SEQ ID NO: 321 - protein, 108 aa, synthetic construct
  REGION 1..108: note = Synthetic peptide
DIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKS

SEQ ID NO: 322 - protein, 246 aa, synthetic construct
  REGION 1..246: note = Synthetic peptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIK

SEQ ID NO: 323 - protein, 501 aa, synthetic construct
  REGION 1..501: note = Synthetic peptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 324 - protein, 989 aa, synthetic construct
  REGION 1..989: note = Synthetic peptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - protein, 124 aa, synthetic construct
  REGION 1..124: note = Synthetic peptide
QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSS

SEQ ID NO: 326 - protein, 107 aa, synthetic construct
  REGION 1..107: note = Synthetic peptide
DIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIK

SEQ ID NO: 327 - protein, 247 aa, synthetic construct
  REGION 1..247: note = Synthetic peptide
QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKS

SEQ ID NO: 328 - protein, 501 aa, synthetic construct
  REGION 1..501: note = Synthetic peptide
QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 329 - protein, 989 aa, synthetic construct
  REGION 1..989: note = Synthetic peptide
QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 330 - protein, 7 aa, synthetic construct
  REGION 1..7: note = Synthetic peptide
NARMGVS

SEQ ID NO: 331 - protein, 16 aa, synthetic construct
  REGION 1..16: note = Synthetic peptide
HIFSNDEKSYSTSLKN

SEQ ID NO: 332 - protein, 14 aa, synthetic construct
  REGION 1..14: note = Synthetic peptide
IVGYGSGWYGFFDY

SEQ ID NO: 333 - protein, 11 aa, synthetic construct
  REGION 1..11: note = Synthetic peptide
RASQGIRNDLG

SEQ ID NO: 334 - protein, 7 aa, synthetic construct
  REGION 1..7: note = Synthetic peptide
AASTLQS

SEQ ID NO: 335 - protein, 9 aa, synthetic construct
  REGION 1..9: note = Synthetic peptide
LQHNSYPLT

SEQ ID NO: 336 - protein, 124 aa, synthetic construct
  REGION 1..124: note = Synthetic peptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSS

SEQ ID NO: 337 - protein, 107 aa, synthetic construct
  REGION 1..107: note = Synthetic peptide
DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIK

SEQ ID NO: 338 - protein, 247 aa, synthetic construct
  REGION 1..247: note = Synthetic peptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIKS

SEQ ID NO: 339 - protein, 501 aa, synthetic construct
  REGION 1..501: note = Synthetic peptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 340 - protein, 989 aa, synthetic construct
  REGION 1..989: note = Synthetic peptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 124 aa, synthetic construct
  REGION 1..124: note = Synthetic peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSS

SEQ ID NO: 342 - protein, 107 aa, synthetic construct
  REGION 1..107: note = Synthetic peptide
DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIK

SEQ ID NO: 343 - protein, 247 aa, synthetic construct
  REGION 1..247: note = Synthetic peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKS

SEQ ID NO: 344 - protein, 501 aa, synthetic construct
  REGION 1..501: note = Synthetic peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 345 - protein, 989 aa, synthetic construct
  REGION 1..989: note = Synthetic peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - protein, 7 aa, synthetic construct
  REGION 1..7: note = Synthetic peptide
NARMAVS

SEQ ID NO: 347 - protein, 16 aa, synthetic construct
  REGION 1..16: note = Synthetic peptide
HIFSNDEKSYSTSLKS

SEQ ID NO: 348 - protein, 14 aa, synthetic construct
  REGION 1..14: note = Synthetic peptide
IVGYGSGWYGYFDY

SEQ ID NO: 349 - protein, 11 aa, synthetic construct
  REGION 1..11: note = Synthetic peptide
RASQDIRNDLG

SEQ ID NO: 350 - protein, 7 aa, synthetic construct
  REGION 1..7: note = Synthetic peptide
AASTLQS

SEQ ID NO: 351 - protein, 9 aa, synthetic construct
  REGION 1..9: note = Synthetic peptide
LQHNSYPLT

SEQ ID NO: 352 - protein, 124 aa, synthetic construct
  REGION 1..124: note = Synthetic peptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSS

SEQ ID NO: 353 - protein, 107 aa, synthetic construct
  REGION 1..107: note = Synthetic peptide
DIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIK

SEQ ID NO: 354 - protein, 247 aa, synthetic construct
  REGION 1..247: note = Synthetic peptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIKS

SEQ ID NO: 355 - protein, 501 aa, synthetic construct
  REGION 1..501: note = Synthetic peptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 356 - protein, 989 aa, synthetic construct
  REGION 1..989: note = Synthetic peptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 124 aa, synthetic construct
  REGION 1..124: note = Synthetic peptide
QVTLKESGPALVKPTETLTLTCTLSGFSLNNARMAVSWIRQPPGKCLEWLAHIFSNDEKSYSTSLKSRLTISKDTSKGQVVLTMTNMDPVDTATYYCARIVGYGSGWYGYFDYWGQGTLVTVSS

SEQ ID NO: 358 - protein, 107 aa, synthetic construct
  REGION 1..107: note = Synthetic peptide
DIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGCGTKVEIK

SEQ ID NO: 359 - protein, 247 aa, synthetic construct
  REGION 1..247: note = Synthetic peptide
QVTLKESGPALVKPTETLTLTCTLSGFSLNNARMAVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGCGTKVEIKS

SEQ ID NO: 360 - protein, 502 aa, synthetic construct
  REGION 1..502: note = Synthetic peptide
QVTLKESGPALVKPTETLTLTCTLSGFSLNNARMAVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLG

SEQ ID NO: 361 - protein, 989 aa, synthetic construct
  REGION 1..989: note = Synthetic peptide
QVTLKESGPALVKPTETLTLTCTLSGFSLNNARMAVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 7 aa, synthetic construct
  REGION 1..7: note = Synthetic peptide
NAKMGVS

SEQ ID NO: 363 - protein, 16 aa, synthetic construct
  REGION 1..16: note = Synthetic peptide
HIFSNDEKSYSTSLKS

SEQ ID NO: 364 - protein, 14 aa, synthetic construct
  REGION 1..14: note = Synthetic peptide
IVGYGSGWYGYFDY

SEQ ID NO: 365 - protein, 11 aa, synthetic construct
  REGION 1..11: note = Synthetic peptide
RASQDIRDDLG

SEQ ID NO: 366 - protein, 7 aa, synthetic construct
  REGION 1..7: note = Synthetic peptide
GASTLQS

SEQ ID NO: 367 - protein, 9 aa, synthetic construct
  REGION 1..9: note = Synthetic peptide
LQHNSYPLT

SEQ ID NO: 368 - protein, 124 aa, synthetic construct
  REGION 1..124: note = Synthetic peptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSS

SEQ ID NO: 369 - protein, 107 aa, synthetic construct
  REGION 1..107: note = Synthetic peptide
DIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIK

SEQ ID NO: 370 - protein, 247 aa, synthetic construct
  REGION 1..247: note = Synthetic peptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKS

SEQ ID NO: 371 - protein, 501 aa, synthetic construct
  REGION 1..501: note = Synthetic peptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 372 - protein, 989 aa, synthetic construct
  REGION 1..989: note = Synthetic peptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 373 - protein, 124 aa, synthetic construct
  REGION 1..124: note = Synthetic peptide
QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSS

SEQ ID NO: 374 - protein, 107 aa, synthetic construct
  REGION 1..107: note = Synthetic peptide
DIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIK

SEQ ID NO: 375 - protein, 247 aa, synthetic construct
  REGION 1..247: note = Synthetic peptide
QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKS

SEQ ID NO: 376 - protein, 501 aa, synthetic construct
  REGION 1..501: note = Synthetic peptide
QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 377 - protein, 989 aa, synthetic construct
  REGION 1..989: note = Synthetic peptide
QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - protein, 7 aa, synthetic construct
  REGION 1..7: note = Synthetic peptide
NARMAVS

SEQ ID NO: 379 - protein, 16 aa, synthetic construct
  REGION 1..16: note = Synthetic peptide
HIFSNDEKSYSTSLKS

SEQ ID NO: 380 - protein, 14 aa, synthetic construct
  REGION 1..14: note = Synthetic peptide
IVGYGSGWYGYFDY

SEQ ID NO: 381 - protein, 11 aa, synthetic construct
  REGION 1..11: note = Synthetic peptide
RASQDIRYDLA

SEQ ID NO: 382 - protein, 7 aa, synthetic construct
  REGION 1..7: note = Synthetic peptide
AASSLQS

SEQ ID NO: 383 - protein, 9 aa, synthetic construct
  REGION 1..9: note = Synthetic peptide
LQHNFYPLT

SEQ ID NO: 384 - protein, 124 aa, synthetic construct
  REGION 1..124: note = Synthetic peptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSS

SEQ ID NO: 385 - protein, 107 aa, synthetic construct
  REGION 1..107: note = Synthetic peptide
DIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIK

SEQ ID NO: 386 - protein, 247 aa, synthetic construct
  REGION 1..247: note = Synthetic peptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIKS

SEQ ID NO: 387 - protein, 501 aa, synthetic construct
  REGION 1..501: note = Synthetic peptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 388 - protein, 989 aa, synthetic construct
  REGION 1..989: note = Synthetic peptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 124 aa, synthetic construct
  REGION 1..124: note = Synthetic peptide
QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSS

SEQ ID NO: 390 - protein, 107 aa, synthetic construct
  REGION 1..107: note = Synthetic peptide
DIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIK

SEQ ID NO: 391 - protein, 247 aa, synthetic construct
  REGION 1..247: note = Synthetic peptide
QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKS

SEQ ID NO: 392 - protein, 501 aa, synthetic construct
  REGION 1..501: note = Synthetic peptide
QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 393 - protein, 989 aa, synthetic construct
  REGION 1..989: note = Synthetic peptide
QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 7 aa, synthetic construct
  REGION 1..7: note = Synthetic peptide
NARMGVS

SEQ ID NO: 395 - protein, 16 aa, synthetic construct
  REGION 1..16: note = Synthetic peptide
HIFSNDEKSFSTSLKN

SEQ ID NO: 396 - protein, 14 aa, synthetic construct
  REGION 1..14: note = Synthetic peptide
MVGYGSGWYAYFDY

SEQ ID NO: 397 - protein, 11 aa, synthetic construct
  REGION 1..11: note = Synthetic peptide
RASQSISSYLN

SEQ ID NO: 398 - protein, 7 aa, synthetic construct
  REGION 1..7: note = Synthetic peptide
AASSLQS

SEQ ID NO: 399 - protein, 9 aa, synthetic construct
  REGION 1..9: note = Synthetic peptide
LQHNSYPLT

SEQ ID NO: 400 - protein, 124 aa, synthetic construct
  REGION 1..124: note = Synthetic peptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSS

SEQ ID NO: 401 - protein, 107 aa, synthetic construct
  REGION 1..107: note = Synthetic peptide
DIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIK

SEQ ID NO: 402 - protein, 247 aa, synthetic construct
  REGION 1..247: note = Synthetic peptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKS

SEQ ID NO: 403 - protein, 501 aa, synthetic construct
  REGION 1..501: note = Synthetic peptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 404 - protein, 989 aa, synthetic construct
  REGION 1..989: note = Synthetic peptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 124 aa, synthetic construct
  REGION 1..124: note = Synthetic peptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSS

SEQ ID NO: 406 - protein, 107 aa, synthetic construct
  REGION 1..107: note = Synthetic peptide
DIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIK

SEQ ID NO: 407 - protein, 247 aa, synthetic construct
  REGION 1..247: note = Synthetic peptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKS

SEQ ID NO: 408 - protein, 501 aa, synthetic construct
  REGION 1..501: note = Synthetic peptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 409 - protein, 989 aa, synthetic construct
  REGION 1..989: note = Synthetic peptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - protein, 7 aa, synthetic construct
  REGION 1..7: note = Synthetic peptide
NARMGVS

SEQ ID NO: 411 - protein, 16 aa, synthetic construct
  REGION 1..16: note = Synthetic peptide
HIFSNDEKSYSTSLKN

SEQ ID NO: 412 - protein, 14 aa, synthetic construct
  REGION 1..14: note = Synthetic peptide
IVGYGTGWFGYFDY

SEQ ID NO: 413 - protein, 11 aa, synthetic construct
  REGION 1..11: note = Synthetic peptide
RASQDIRTDLA

SEQ ID NO: 414 - protein, 7 aa, synthetic construct
  REGION 1..7: note = Synthetic peptide
AASSLQS

SEQ ID NO: 415 - protein, 9 aa, synthetic construct
  REGION 1..9: note = Synthetic peptide
LQHNRYPLT

SEQ ID NO: 416 - protein, 124 aa, synthetic construct
  REGION 1..124: note = Synthetic peptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSS

SEQ ID NO: 417 - protein, 107 aa, synthetic construct
  REGION 1..107: note = Synthetic peptide
DIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIK

SEQ ID NO: 418 - protein, 247 aa, synthetic construct
  REGION 1..247: note = Synthetic peptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKS

SEQ ID NO: 419 - protein, 501 aa, synthetic construct
  REGION 1..501: note = Synthetic peptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 420 - protein, 989 aa, synthetic construct
  REGION 1..989: note = Synthetic peptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 124 aa, synthetic construct
  REGION 1..124: note = Synthetic peptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSS

SEQ ID NO: 422 - protein, 107 aa, synthetic construct
  REGION 1..107: note = Synthetic peptide
DIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIK

SEQ ID NO: 423 - protein, 247 aa, synthetic construct
  REGION 1..247: note = Synthetic peptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIKS

SEQ ID NO: 424 - protein, 501 aa, synthetic construct
  REGION 1..501: note = Synthetic peptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 425 - protein, 989 aa, synthetic construct
  REGION 1..989: note = Synthetic peptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 7 aa, synthetic construct
  REGION 1..7: note = Synthetic peptide
NARMAVS

SEQ ID NO: 427 - protein, 16 aa, synthetic construct
  REGION 1..16: note = Synthetic peptide
HIFSNDEKSYSTSLKS

SEQ ID NO: 428 - protein, 14 aa, synthetic construct
  REGION 1..14: note = Synthetic peptide
IVGYGTGWYGFFDY

SEQ ID NO: 429 - protein, 11 aa, synthetic construct
  REGION 1..11: note = Synthetic peptide
RASQGIRNDLA

SEQ ID NO: 430 - protein, 7 aa, synthetic construct
  REGION 1..7: note = Synthetic peptide
AASSLQS

SEQ ID NO: 431 - protein, 9 aa, synthetic construct
  REGION 1..9: note = Synthetic peptide
LQHNSYPLT

SEQ ID NO: 432 - protein, 124 aa, synthetic construct
  REGION 1..124: note = Synthetic peptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSS

SEQ ID NO: 433 - protein, 107 aa, synthetic construct
  REGION 1..107: note = Synthetic peptide
DIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIK

SEQ ID NO: 434 - protein, 247 aa, synthetic construct
  REGION 1..247: note = Synthetic peptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIKS

SEQ ID NO: 435 - protein, 501 aa, synthetic construct
  REGION 1..501: note = Synthetic peptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 436 - protein, 989 aa, synthetic construct
  REGION 1..989: note = Synthetic peptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 437 - protein, 124 aa, synthetic construct
  REGION 1..124: note = Synthetic peptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSS

SEQ ID NO: 438 - protein, 107 aa, synthetic construct
  REGION 1..107: note = Synthetic peptide
DIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIK

SEQ ID NO: 439 - protein, 247 aa, synthetic construct
  REGION 1..247: note = Synthetic peptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKS

SEQ ID NO: 440 - protein, 501 aa, synthetic construct
  REGION 1..501: note = Synthetic peptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 441 - protein, 989 aa, synthetic construct
  REGION 1..989: note = Synthetic peptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 7 aa, synthetic construct
  REGION 1..7: note = Synthetic peptide
YARMGVS

SEQ ID NO: 443 - protein, 16 aa, synthetic construct
  REGION 1..16: note = Synthetic peptide
HIFSNDEKSYSTSLKS

SEQ ID NO: 444 - protein, 14 aa, synthetic construct
  REGION 1..14: note = Synthetic peptide
MPEYSSGWSGAFDI

SEQ ID NO: 445 - protein, 11 aa, synthetic construct
  REGION 1..11: note = Synthetic peptide
RASQDIRNDLA

SEQ ID NO: 446 - protein, 7 aa, synthetic construct
  REGION 1..7: note = Synthetic peptide
AASSLQS

SEQ ID NO: 447 - protein, 9 aa, synthetic construct
  REGION 1..9: note = Synthetic peptide
LQHNSYPLT

SEQ ID NO: 448 - protein, 124 aa, synthetic construct
  REGION 1..124: note = Synthetic peptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 449 - protein, 107 aa, synthetic construct
  REGION 1..107: note = Synthetic peptide
DIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIK

SEQ ID NO: 450 - protein, 247 aa, synthetic construct
  REGION 1..247: note = Synthetic peptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKS

SEQ ID NO: 451 - protein, 501 aa, synthetic construct
  REGION 1..501: note = Synthetic peptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 452 - protein, 989 aa, synthetic construct
  REGION 1..989: note = Synthetic peptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 453 - protein, 124 aa, synthetic construct
  REGION 1..124: note = Synthetic peptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSS

SEQ ID NO: 454 - protein, 107 aa, synthetic construct
  REGION 1..107: note = Synthetic peptide
DIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIK

SEQ ID NO: 455 - protein, 247 aa, synthetic construct
  REGION 1..247: note = Synthetic peptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIKS

SEQ ID NO: 456 - protein, 501 aa, synthetic construct
  REGION 1..501: note = Synthetic peptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 457 - protein, 989 aa, synthetic construct
  REGION 1..989: note = Synthetic peptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 7 aa, synthetic construct
  REGION 1..7: note = Synthetic peptide
NARMGVS

SEQ ID NO: 459 - protein, 16 aa, synthetic construct
  REGION 1..16: note = Synthetic peptide
HIFSNDEKSYSTSLKS

SEQ ID NO: 460 - protein, 14 aa, synthetic construct
  REGION 1..14: note = Synthetic peptide
MPEYSSGWSGAFDI

SEQ ID NO: 461 - protein, 11 aa, synthetic construct
  REGION 1..11: note = Synthetic peptide
RASQDIRDDLG

SEQ ID NO: 462 - protein, 7 aa, synthetic construct
  REGION 1..7: note = Synthetic peptide
GASTLQS

SEQ ID NO: 463 - protein, 9 aa, synthetic construct
  REGION 1..9: note = Synthetic peptide
LQHNSYPLT

SEQ ID NO: 464 - protein, 124 aa, synthetic construct
  REGION 1..124: note = Synthetic peptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 465 - protein, 107 aa, synthetic construct; identical to SEQ ID NO: 369
  REGION 1..107: note = Synthetic peptide

SEQ ID NO: 466 - protein, 247 aa, synthetic construct
  REGION 1..247: note = Synthetic peptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKS

SEQ ID NO: 467 - protein, 501 aa, synthetic construct
  REGION 1..501: note = Synthetic peptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 468 - protein, 989 aa, synthetic construct
  REGION 1..989: note = Synthetic peptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - protein, 124 aa, synthetic construct
  REGION 1..124: note = Synthetic peptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSS

SEQ ID NO: 470 - protein, 107 aa, synthetic construct; identical to SEQ ID NO: 374
  REGION 1..107: note = Synthetic peptide

SEQ ID NO: 471 - protein, 247 aa, synthetic construct
  REGION 1..247: note = Synthetic peptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKS

SEQ ID NO: 472 - protein, 501 aa, synthetic construct
  REGION 1..501: note = Synthetic peptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 473 - protein, 989 aa, synthetic construct
  REGION 1..989: note = Synthetic peptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 7 aa, synthetic construct
  REGION 1..7: note = Synthetic peptide
NARMGVS

SEQ ID NO: 475 - protein, 16 aa, synthetic construct
  REGION 1..16: note = Synthetic peptide
HIFSNDEKSYSTSLKS

SEQ ID NO: 476 - protein, 14 aa, synthetic construct
  REGION 1..14: note = Synthetic peptide
MPEYSSGWSGAFDI

SEQ ID NO: 477 - protein, 11 aa, synthetic construct
  REGION 1..11: note = Synthetic peptide
RASQDIGYDLG

SEQ ID NO: 478 - protein, 7 aa, synthetic construct
  REGION 1..7: note = Synthetic peptide
AASTLQS

SEQ ID NO: 479 - protein, 9 aa, synthetic construct
  REGION 1..9: note = Synthetic peptide
LQHNSFPWT

SEQ ID NO: 480 - protein, 124 aa, synthetic construct
  REGION 1..124: note = Synthetic peptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 481 - protein, 107 aa, synthetic construct
  REGION 1..107: note = Synthetic peptide
DIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIK

SEQ ID NO: 482 - protein, 247 aa, synthetic construct
  REGION 1..247: note = Synthetic peptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIKS

SEQ ID NO: 483 - protein, 501 aa, synthetic construct
  REGION 1..501: note = Synthetic peptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 484 - protein, 989 aa, synthetic construct
  REGION 1..989: note = Synthetic peptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 124 aa, synthetic construct
  REGION 1..124: note = Synthetic peptide
QVTLKESGPALVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSS

SEQ ID NO: 486 - protein, 107 aa, synthetic construct
  REGION 1..107: note = Synthetic peptide
DIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGCGTKVEIK

SEQ ID NO: 487 - protein, 247 aa, synthetic construct
  REGION 1..247: note = Synthetic peptide
QVTLKESGPALVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGCGTKVEIKS

SEQ ID NO: 488 - protein, 501 aa, synthetic construct
  REGION 1..501: note = Synthetic peptide
QVTLKESGPALVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 489 - protein, 989 aa, synthetic construct
  REGION 1..989: note = Synthetic peptide
QVTLKESGPALVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 7 aa, synthetic construct
  REGION 1..7: note = Synthetic peptide
NARMGVS

SEQ ID NO: 491 - protein, 16 aa, synthetic construct
  REGION 1..16: note = Synthetic peptide
HIFSNDEKSYRTSLKS

SEQ ID NO: 492 - protein, 14 aa, synthetic construct
  REGION 1..14: note = Synthetic peptide
IVGYGSGWYAYFDY

SEQ ID NO: 493 - protein, 11 aa, synthetic construct
  REGION 1..11: note = Synthetic peptide
RASQGIRNDLG

SEQ ID NO: 494 - protein, 7 aa, synthetic construct
  REGION 1..7: note = Synthetic peptide
AASSLQS

SEQ ID NO: 495 - protein, 9 aa, synthetic construct
  REGION 1..9: note = Synthetic peptide
LQHNSYPLT

SEQ ID NO: 496 - protein, 124 aa, synthetic construct
  REGION 1..124: note = Synthetic peptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSS

SEQ ID NO: 497 - protein, 107 aa, synthetic construct
  REGION 1..107: note = Synthetic peptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 498 - protein, 247 aa, synthetic construct
  REGION 1..247: note = Synthetic peptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKS

SEQ ID NO: 499 - protein, 501 aa, synthetic construct
  REGION 1..501: note = Synthetic peptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 500 - protein, 989 aa, synthetic construct
  REGION 1..989: note = Synthetic peptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 124 aa, synthetic construct
  REGION 1..124: note = Synthetic peptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSS

SEQ ID NO: 502 - protein, 107 aa, synthetic construct
  REGION 1..107: note = Synthetic peptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIK

SEQ ID NO: 503 - protein, 247 aa, synthetic construct
  REGION 1..247: note = Synthetic peptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKS

SEQ ID NO: 504 - protein, 501 aa, synthetic construct
  REGION 1..501: note = Synthetic peptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 505 - protein, 989 aa, synthetic construct
  REGION 1..989: note = Synthetic peptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 506 - protein, 7 aa, synthetic construct
  REGION 1..7: note = Synthetic peptide
NARMGVS

SEQ ID NO: 507 - protein, 16 aa, synthetic construct
  REGION 1..16: note = Synthetic peptide
LIYWNDDKRYSPSLKS

SEQ ID NO: 508 - protein, 14 aa, synthetic construct
  REGION 1..14: note = Synthetic peptide
MVGYGSGWYAYFDY

SEQ ID NO: 509 - protein, 11 aa, synthetic construct
  REGION 1..11: note = Synthetic peptide
RASQGIRNDLG

SEQ ID NO: 510 - protein, 7 aa, synthetic construct
  REGION 1..7: note = Synthetic peptide
AASSLQS

SEQ ID NO: 511 - protein, 9 aa, synthetic construct
  REGION 1..9: note = Synthetic peptide
LQHNSYPLT

SEQ ID NO: 512 - protein, 124 aa, synthetic construct
  REGION 1..124: note = Synthetic peptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSS

SEQ ID NO: 513 - protein, 107 aa, synthetic construct; identical to SEQ ID NO: 497
  REGION 1..107: note = Synthetic peptide

SEQ ID NO: 514 - protein, 247 aa, synthetic construct
  REGION 1..247: note = Synthetic peptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKS

SEQ ID NO: 515 - protein, 501 aa, synthetic construct
  REGION 1..501: note = Synthetic peptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 516 - protein, 989 aa, synthetic construct
  REGION 1..989: note = Synthetic peptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 124 aa, synthetic construct
  REGION 1..124: note = Synthetic peptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSS

SEQ ID NO: 518 - protein, 107 aa, synthetic construct; identical to SEQ ID NO: 502
  REGION 1..107: note = Synthetic peptide

SEQ ID NO: 519 - protein, 247 aa, synthetic construct
  REGION 1..247: note = Synthetic peptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKS

SEQ ID NO: 520 - protein, 501 aa, synthetic construct
  REGION 1..501: note = Synthetic peptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 521 - protein, 989 aa, synthetic construct
  REGION 1..989: note = Synthetic peptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 7 aa, synthetic construct
  REGION 1..7: note = Synthetic peptide
NARMGVS

SEQ ID NO: 523 - protein, 16 aa, synthetic construct
  REGION 1..16: note = Synthetic peptide
HIFSNDEKSYSTSLKS

SEQ ID NO: 524 - protein, 14 aa, synthetic construct
  REGION 1..14: note = Synthetic peptide
IVGYGTGWYGFFDY

SEQ ID NO: 525 - protein, 11 aa, synthetic construct
  REGION 1..11: note = Synthetic peptide
RTSQGIRNDLG

SEQ ID NO: 526 - protein, 7 aa, synthetic construct
  REGION 1..7: note = Synthetic peptide
AASSLQS

SEQ ID NO: 527 - protein, 9 aa, synthetic construct
  REGION 1..9: note = Synthetic peptide
LQHNSYPLT

SEQ ID NO: 528 - protein, 124 aa, synthetic construct
  REGION 1..124: note = Synthetic peptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSS

SEQ ID NO: 529 - protein, 107 aa, synthetic construct
  REGION 1..107: note = Synthetic peptide
DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIK

SEQ ID NO: 530 - protein, 247 aa, synthetic construct
  REGION 1..247: note = Synthetic peptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKS

SEQ ID NO: 531 - protein, 501 aa, synthetic construct
  REGION 1..501: note = Synthetic peptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 532 - protein, 989 aa, synthetic construct
  REGION 1..989: note = Synthetic peptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 124 aa, synthetic construct
  REGION 1..124: note = Synthetic peptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSS

SEQ ID NO: 534 - protein, 107 aa, synthetic construct
  REGION 1..107: note = Synthetic peptide
DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIK

SEQ ID NO: 535 - protein, 247 aa, synthetic construct
  REGION 1..247: note = Synthetic peptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKS

SEQ ID NO: 536 - protein, 501 aa, synthetic construct
  REGION 1..501: note = Synthetic peptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 537 - protein, 989 aa, synthetic construct
  REGION 1..989: note = Synthetic peptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 538 - protein, 5 aa, synthetic construct
  REGION 1..5: note = Synthetic peptide
SYGMH

SEQ ID NO: 539 - protein, 17 aa, synthetic construct
  REGION 1..17: note = Synthetic peptide
VISYEGSNEFYAESVKG

SEQ ID NO: 540 - protein, 20 aa, synthetic construct
  REGION 1..20: note = Synthetic peptide
GGEITMVRGVIGYYYYGMDV

SEQ ID NO: 541 - protein, 11 aa, synthetic construct
  REGION 1..11: note = Synthetic peptide
RASQSISSYLN

SEQ ID NO: 542 - protein, 7 aa, synthetic construct
  REGION 1..7: note = Synthetic peptide
AASSLQS

SEQ ID NO: 543 - protein, 9 aa, synthetic construct
  REGION 1..9: note = Synthetic peptide
LQHNSYPLT

SEQ ID NO: 544 - protein, 129 aa, synthetic construct
  REGION 1..129: note = Synthetic peptide
QVQLVESGGGVVQPGRSLRLSCAASGFTFSSYGMHWVRQAPGKGLEWVAVISYEGSNEFYAESVKGRFTISRDNSKNTLYLQMNSLRAEDTAVYYCARGGEITMVRGVIGYYYYGMDVWGQGTTVTVSS

SEQ ID NO: 545 - protein, 107 aa, synthetic construct
  REGION 1..107: note = Synthetic peptide
DIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIK

SEQ ID NO: 546 - protein, 252 aa, synthetic construct
  REGION 1..252: note = Synthetic peptide
QVQLVESGGGVVQPGRSLRLSCAASGFTFSSYGMHWVRQAPGKGLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIKS

SEQ ID NO: 547 - protein, 506 aa, synthetic construct
  REGION 1..506: note = Synthetic peptide
QVQLVESGGGVVQPGRSLRLSCAASGFTFSSYGMHWVRQAPGKGLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 548 - protein, 994 aa, synthetic construct
  REGION 1..994: note = Synthetic peptide
QVQLVESGGGVVQPGRSLRLSCAASGFTFSSYGMHWVRQAPGKGLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 549 - protein, 129 aa, synthetic construct
  REGION 1..129: note = Synthetic peptide
QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSS

SEQ ID NO: 550 - protein, 107 aa, synthetic construct
  REGION 1..107: note = Synthetic peptide
DIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIK

SEQ ID NO: 551 - protein, 252 aa, synthetic construct
  REGION 1..252: note = Synthetic peptide
QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKS

SEQ ID NO: 552 - protein, 506 aa, synthetic construct
  REGION 1..506: note = Synthetic peptide
QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 553 - protein, 994 aa, synthetic construct
  REGION 1..994: note = Synthetic peptide
QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 554 - protein, 987 aa, synthetic construct
  REGION 1..987: note = Synthetic peptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 555 - protein, 987 aa, synthetic construct
  REGION 1..987: note = Synthetic peptide
QVTLKESGPALVKPTETLTLTCTVSGFSLSNARMGVSWIRQPPGKCLEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 556 - protein, 987 aa, synthetic construct
  REGION 1..987: note = Synthetic peptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 557 - protein, 987 aa, synthetic construct
  REGION 1..987: note = Synthetic peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 558 - protein, 987 aa, synthetic construct
  REGION 1..987: note = Synthetic peptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 987 aa, synthetic construct
  REGION 1..987: note = Synthetic peptide
QVTLKESGPALVKPTETLTLTCTLSGFSLNNARMAVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 560 - protein, 987 aa, synthetic construct
  REGION 1..987: note = Synthetic peptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 561 - protein, 987 aa, synthetic construct
  REGION 1..987: note = Synthetic peptide
QVTLKESGPALVKPTETLTLTCTLSGFSLNNAKMGVSWIRQPPGKCLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 987 aa, synthetic construct
  REGION 1..987: note = Synthetic peptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - protein, 987 aa, synthetic construct
  REGION 1..987: note = Synthetic peptide
QVTLKESGPVLVKPTETLTLTCTVSGFSLRNARMAVSWIRQPPGKCLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 987 aa, synthetic construct
  REGION 1..987: note = Synthetic peptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 987 aa, synthetic construct
  REGION 1..987: note = Synthetic peptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 566 - protein, 987 aa, synthetic construct
  REGION 1..987: note = Synthetic peptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 567 - protein, 987 aa, synthetic construct
  REGION 1..987: note = Synthetic peptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 568 - protein, 987 aa, synthetic construct
  REGION 1..987: note = Synthetic peptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 987 aa, synthetic construct
  REGION 1..987: note = Synthetic peptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 570 - protein, 987 aa, synthetic construct
  REGION 1..987: note = Synthetic peptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 571 - protein, 987 aa, synthetic construct
  REGION 1..987: note = Synthetic peptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 572 - protein, 987 aa, synthetic construct
  REGION 1..987: note = Synthetic peptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 573 - protein, 987 aa, synthetic construct
  REGION 1..987: note = Synthetic peptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 574 - protein, 987 aa, synthetic construct
  REGION 1..987: note = Synthetic peptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - protein, 987 aa, synthetic construct
  REGION 1..987: note = Synthetic peptide
QVTLKESGPALVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 576 - protein, 987 aa, synthetic construct
  REGION 1..987: note = Synthetic peptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 987 aa, synthetic construct
  REGION 1..987: note = Synthetic peptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 987 aa, synthetic construct
  REGION 1..987: note = Synthetic peptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 987 aa, synthetic construct
  REGION 1..987: note = Synthetic peptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 580 - protein, 987 aa, synthetic construct
  REGION 1..987: note = Synthetic peptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - protein, 987 aa, synthetic construct
  REGION 1..987: note = Synthetic peptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 582 - protein, 992 aa, synthetic construct
  REGION 1..992: note = Synthetic peptide
QVQLVESGGGVVQPGRSLRLSCAASGFTFSSYGMHWVRQAPGKGLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - protein, 992 aa, synthetic construct
  REGION 1..992: note = Synthetic peptide
QVQLVESGGGVVQPGRSLRLSCAASGFTFSSYGMHWVRQAPGKCLEWVAVISYEGSNEFYAESVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 5 aa, synthetic construct
  REGION 1..5: note = Synthetic peptide
SYAMS

SEQ ID NO: 585 - protein, 17 aa, synthetic construct
  REGION 1..17: note = Synthetic peptide
VISGSGGRPNYAESVKG

SEQ ID NO: 586 - protein, 11 aa, synthetic construct
  REGION 1..11: note = Synthetic peptide
VDYSNYLFFDY

SEQ ID NO: 587 - protein, 12 aa, synthetic construct
  REGION 1..12: note = Synthetic peptide
RAGQSVRSSYLG

SEQ ID NO: 588 - protein, 7 aa, synthetic construct
  REGION 1..7: note = Synthetic peptide
GASSRAT

SEQ ID NO: 589 - protein, 9 aa, synthetic construct
  REGION 1..9: note = Synthetic peptide
QQYGYSPPT

SEQ ID NO: 590 - protein, 120 aa, synthetic construct
  REGION 1..120: note = Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSS

SEQ ID NO: 591 - protein, 108 aa, synthetic construct
  REGION 1..108: note = Synthetic peptide
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIK

SEQ ID NO: 592 - protein, 243 aa, synthetic construct
  REGION 1..243: note = Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIK

SEQ ID NO: 593 - protein, 498 aa, synthetic construct
  REGION 1..498: note = Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 594 - protein, 986 aa, synthetic construct
  REGION 1..986: note = Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 595 - protein, 120 aa, synthetic construct
  REGION 1..120: note = Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSS

SEQ ID NO: 596 - protein, 108 aa, synthetic construct
  REGION 1..108: note = Synthetic peptide
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 597 - protein, 243 aa, synthetic construct
  REGION 1..243: note = Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 598 - protein, 498 aa, synthetic construct
  REGION 1..498: note = Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 599 - protein, 986 aa, synthetic construct
  REGION 1..986: note = Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 600 - protein, 5 aa, synthetic construct
  REGION 1..5: note = Synthetic peptide
IYAMS

SEQ ID NO: 601 - protein, 17 aa, synthetic construct
  REGION 1..17: note = Synthetic peptide
AISGSGGSTFYAESVKG

SEQ ID NO: 602 - protein, 11 aa, synthetic construct
  REGION 1..11: note = Synthetic peptide
HDYSNYPYFDY

SEQ ID NO: 603 - protein, 12 aa, synthetic construct
  REGION 1..12: note = Synthetic peptide
RASQSVRSSYLA

SEQ ID NO: 604 - protein, 7 aa, synthetic construct
  REGION 1..7: note = Synthetic peptide
GASSRAT

SEQ ID NO: 605 - protein, 9 aa, synthetic construct
  REGION 1..9: note = Synthetic peptide
QQYGDLPFT

SEQ ID NO: 606 - protein, 120 aa, synthetic construct
  REGION 1..120: note = Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSS

SEQ ID NO: 607 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 608 - protein, 243 aa, synthetic construct
  REGION 1..243: note = Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 609 - protein, 498 aa, synthetic construct
  REGION 1..498: note = Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 610 - protein, 986 aa, synthetic construct
  REGION 1..986: note = Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 120 aa, synthetic construct
  REGION 1..120: note = Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSS

SEQ ID NO: 612 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 613 - protein, 243 aa, synthetic construct
  REGION 1..243: note = Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 614 - protein, 498 aa, synthetic construct
  REGION 1..498: note = Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 615 - protein, 986 aa, synthetic construct
  REGION 1..986: note = Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 616 - protein, 5 aa, synthetic construct
  REGION 1..5: note = Synthetic peptide
SYAMS

SEQ ID NO: 617 - protein, 17 aa, synthetic construct
  REGION 1..17: note = Synthetic peptide
AISGSGGRTFYAESVEG

SEQ ID NO: 618 - protein, 11 aa, synthetic construct
  REGION 1..11: note = Synthetic peptide
HDYSNYPYFDY

SEQ ID NO: 619 - protein, 12 aa, synthetic construct
  REGION 1..12: note = Synthetic peptide
RASQSVRSSYLA

SEQ ID NO: 620 - protein, 7 aa, synthetic construct
  REGION 1..7: note = Synthetic peptide
GASSRAT

SEQ ID NO: 621 - protein, 9 aa, synthetic construct
  REGION 1..9: note = Synthetic peptide
QQYGSSPFT

SEQ ID NO: 622 - protein, 120 aa, synthetic construct
  REGION 1..120: note = Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSS

SEQ ID NO: 623 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 624 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 625 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 626 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 120 aa, synthetic construct
  REGION 1..120: note = Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSS

SEQ ID NO: 628 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 629 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 630 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 631 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 632 - protein, 5 aa, synthetic construct
  REGION 1..5: note = Synthetic peptide
SYAMS

SEQ ID NO: 633 - protein, 17 aa, synthetic construct
  REGION 1..17: note = Synthetic peptide
AISGSGGRTFYAESVEG

SEQ ID NO: 634 - protein, 11 aa, synthetic construct
  REGION 1..11: note = Synthetic peptide
HDYSNYPYFDY

SEQ ID NO: 635 - protein, 12 aa, synthetic construct
  REGION 1..12: note = Synthetic peptide
RASQSIRSSYLA

SEQ ID NO: 636 - protein, 7 aa, synthetic construct
  REGION 1..7: note = Synthetic peptide
GASSRAT

SEQ ID NO: 637 - protein, 9 aa, synthetic construct
  REGION 1..9: note = Synthetic peptide
QQYGDLPFT

SEQ ID NO: 638 - protein, 120 aa, synthetic construct
  REGION 1..120: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 639 - protein, 108 aa, synthetic construct
  REGION 1..108: note = Synthetic peptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 640 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 641 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 642 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - protein, 120 aa, synthetic construct
  REGION 1..120: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 644 - protein, 108 aa, synthetic construct
  REGION 1..108: note = Synthetic peptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 645 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 646 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 647 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 648 - protein, 5 aa, synthetic construct
  REGION 1..5: note = Synthetic peptide
SYAMS

SEQ ID NO: 649 - protein, 17 aa, synthetic construct
  REGION 1..17: note = Synthetic peptide
AISGSGGRTHYAESVKG

SEQ ID NO: 650 - protein, 11 aa, synthetic construct
  REGION 1..11: note = Synthetic peptide
HDYSNYPYFDY

SEQ ID NO: 651 - protein, 12 aa, synthetic construct
  REGION 1..12: note = Synthetic peptide
RASQSVRSSYLA

SEQ ID NO: 652 - protein, 7 aa, synthetic construct
  REGION 1..7: note = Synthetic peptide
GASSRAT

SEQ ID NO: 653 - protein, 9 aa, synthetic construct
  REGION 1..9: note = Synthetic peptide
QQYGSSPFT

SEQ ID NO: 654 - protein, 120 aa, synthetic construct
  REGION 1..120: note = Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSS

SEQ ID NO: 655 - protein, 108 aa, synthetic construct; identical to SEQ ID NO: 623
  REGION 1..108: note = Synthetic peptide

SEQ ID NO: 656 - protein, 243 aa, synthetic construct
  REGION 1..243: note = Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIK

SEQ ID NO: 657 - protein, 498 aa, synthetic construct
  REGION 1..498: note = Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 658 - protein, 986 aa, synthetic construct
  REGION 1..986: note = Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - protein, 120 aa, synthetic construct
  REGION 1..120: note = Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSS

SEQ ID NO: 660 - protein, 108 aa, synthetic construct; identical to SEQ ID NO: 628
  REGION 1..108: note = Synthetic peptide

SEQ ID NO: 661 - protein, 243 aa, synthetic construct
  REGION 1..243: note = Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 662 - protein, 498 aa, synthetic construct
  REGION 1..498: note = Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 663 - protein, 986 aa, synthetic construct
  REGION 1..986: note = Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 664 - protein, 5 aa, synthetic construct
  REGION 1..5: note = Synthetic peptide
SYAMS

SEQ ID NO: 665 - protein, 17 aa, synthetic construct
  REGION 1..17: note = Synthetic peptide
LISGSGGRTHYAESVKG

SEQ ID NO: 666 - protein, 11 aa, synthetic construct
  REGION 1..11: note = Synthetic peptide
HDYSNYPYFDY

SEQ ID NO: 667 - protein, 12 aa, synthetic construct
  REGION 1..12: note = Synthetic peptide
RASQSVRSTYLA

SEQ ID NO: 668 - protein, 7 aa, synthetic construct
  REGION 1..7: note = Synthetic peptide
DASSRAT

SEQ ID NO: 669 - protein, 9 aa, synthetic construct
  REGION 1..9: note = Synthetic peptide
QQYGSSPPT

SEQ ID NO: 670 - protein, 120 aa, synthetic construct
  REGION 1..120: note = Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSS

SEQ ID NO: 671 - protein, 108 aa, synthetic construct
  REGION 1..108: note = Synthetic peptide
EIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIK

SEQ ID NO: 672 - protein, 243 aa, synthetic construct
  REGION 1..243: note = Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIK

SEQ ID NO: 673 - protein, 498 aa, synthetic construct
  REGION 1..498: note = Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 674 - protein, 986 aa, synthetic construct
  REGION 1..986: note = Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 120 aa, synthetic construct
  REGION 1..120: note = Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSS

SEQ ID NO: 676 - protein, 108 aa, synthetic construct
  REGION 1..108: note = Synthetic peptide
EIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 677 - protein, 243 aa, synthetic construct
  REGION 1..243: note = Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 678 - protein, 498 aa, synthetic construct
  REGION 1..498: note = Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 679 - protein, 986 aa, synthetic construct
  REGION 1..986: note = Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 680 - protein, 5 aa, synthetic construct
  REGION 1..5: note = Synthetic peptide
TYAMS

SEQ ID NO: 681 - protein, 17 aa, synthetic construct
  REGION 1..17: note = Synthetic peptide
AISGSGGSTFYAESVKG

SEQ ID NO: 682 - protein, 11 aa, synthetic construct
  REGION 1..11: note = Synthetic peptide
HDYSNYPYFDY

SEQ ID NO: 683 - protein, 12 aa, synthetic construct
  REGION 1..12: note = Synthetic peptide
RASQSVRSSYLA

SEQ ID NO: 684 - protein, 7 aa, synthetic construct
  REGION 1..7: note = Synthetic peptide
GASSRAT

SEQ ID NO: 685 - protein, 9 aa, synthetic construct
  REGION 1..9: note = Synthetic peptide
QQYGDLPFT

SEQ ID NO: 686 - protein, 120 aa, synthetic construct
  REGION 1..120: note = Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSS

SEQ ID NO: 687 - protein, 108 aa, synthetic construct; identical to SEQ ID NO: 607
  REGION 1..108: note = Synthetic peptide

SEQ ID NO: 688 - protein, 243 aa, synthetic construct
  REGION 1..243: note = Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIK

SEQ ID NO: 689 - protein, 498 aa, synthetic construct
  REGION 1..498: note = Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 690 - protein, 986 aa, synthetic construct
  REGION 1..986: note = Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 691 - protein, 120 aa, synthetic construct
  REGION 1..120: note = Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSS

SEQ ID NO: 692 - protein, 108 aa, synthetic construct; identical to SEQ ID NO: 612
  REGION 1..108: note = Synthetic peptide

SEQ ID NO: 693 - protein, 243 aa, synthetic construct
  REGION 1..243: note = Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 694 - protein, 498 aa, synthetic construct
  REGION 1..498: note = Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 695 - protein, 986 aa, synthetic construct
  REGION 1..986: note = Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 696 - protein, 5 aa, synthetic construct
  REGION 1..5: note = Synthetic peptide
TYAMS

SEQ ID NO: 697 - protein, 17 aa, synthetic construct
  REGION 1..17: note = Synthetic peptide
AISGSGGRTFYAESVEG

SEQ ID NO: 698 - protein, 11 aa, synthetic construct
  REGION 1..11: note = Synthetic peptide
HDYSNYPYFDY

SEQ ID NO: 699 - protein, 12 aa, synthetic construct
  REGION 1..12: note = Synthetic peptide
RASQSVRSTYLA

SEQ ID NO: 700 - protein, 7 aa, synthetic construct
  REGION 1..7: note = Synthetic peptide
GASSRAT

SEQ ID NO: 701 - protein, 9 aa, synthetic construct
  REGION 1..9: note = Synthetic peptide
QQYGDLPFT

SEQ ID NO: 702 - protein, 120 aa, synthetic construct
  REGION 1..120: note = Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 703 - protein, 108 aa, synthetic construct
  REGION 1..108: note = Synthetic peptide
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 704 - protein, 243 aa, synthetic construct
  REGION 1..243: note = Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 705 - protein, 498 aa, synthetic construct
  REGION 1..498: note = Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 706 - protein, 986 aa, synthetic construct
  REGION 1..986: note = Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 707 - protein, 120 aa, synthetic construct
  REGION 1..120: note = Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 708 - protein, 108 aa, synthetic construct
  REGION 1..108: note = Synthetic peptide
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 709 - protein, 243 aa, synthetic construct
  REGION 1..243: note = Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 710 - protein, 498 aa, synthetic construct
  REGION 1..498: note = Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 711 - protein, 986 aa, synthetic construct
  REGION 1..986: note = Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 712 - protein, 5 aa, synthetic construct
  REGION 1..5: note = Synthetic peptide
SYAMS

SEQ ID NO: 713 - protein, 17 aa, synthetic construct
  REGION 1..17: note = Synthetic peptide
AISGSGGYTYYAESVKG

SEQ ID NO: 714 - protein, 11 aa, synthetic construct
  REGION 1..11: note = Synthetic peptide
HDYSNYPYFDY

SEQ ID NO: 715 - protein, 12 aa, synthetic construct
  REGION 1..12: note = Synthetic peptide
RASQSVRSNYLA

SEQ ID NO: 716 - protein, 7 aa, synthetic construct
  REGION 1..7: note = Synthetic peptide
GASSRAT

SEQ ID NO: 717 - protein, 9 aa, synthetic construct
  REGION 1..9: note = Synthetic peptide
QQYGDLPFT

SEQ ID NO: 718 - protein, 120 aa, synthetic construct
  REGION 1..120: note = Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSS

SEQ ID NO: 719 - protein, 108 aa, synthetic construct
  REGION 1..108: note = Synthetic peptide
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 720 - protein, 243 aa, synthetic construct
  REGION 1..243: note = Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 721 - protein, 498 aa, synthetic construct
  REGION 1..498: note = Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 722 - protein, 986 aa, synthetic construct
  REGION 1..986: note = Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 723 - protein, 120 aa, synthetic construct
  REGION 1..120: note = Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSS

SEQ ID NO: 724 - protein, 108 aa, synthetic construct
  REGION 1..108: note = Synthetic peptide
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 725 - protein, 243 aa, synthetic construct
  REGION 1..243: note = Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 726 - protein, 498 aa, synthetic construct
  REGION 1..498: note = Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 727 - protein, 986 aa, synthetic construct
  REGION 1..986: note = Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 728 - protein, 5 aa, synthetic construct
  REGION 1..5: note = Synthetic peptide
SYAMS

SEQ ID NO: 729 - protein, 17 aa, synthetic construct
  REGION 1..17: note = Synthetic peptide
AISGSGGSTFYAESVKG

SEQ ID NO: 730 - protein, 11 aa, synthetic construct
  REGION 1..11: note = Synthetic peptide
HDYSNYPYFDY

SEQ ID NO: 731 - protein, 12 aa, synthetic construct
  REGION 1..12: note = Synthetic peptide
RASQSVRSSYLA

SEQ ID NO: 732 - protein, 7 aa, synthetic construct
  REGION 1..7: note = Synthetic peptide
GASSRAT

SEQ ID NO: 733 - protein, 9 aa, synthetic construct
  REGION 1..9: note = Synthetic peptide
QQYGDLPFT

SEQ ID NO: 734 - protein, 120 aa, synthetic construct
  REGION 1..120: note = Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSS

SEQ ID NO: 735 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 736 - protein, 243 aa, synthetic construct
  REGION 1..243: note = Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 737 - protein, 498 aa, synthetic construct
  REGION 1..498: note = Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 738 - protein, 986 aa, synthetic construct
  REGION 1..986: note = Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 739 - protein, 120 aa, synthetic construct
  REGION 1..120: note = Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSS

SEQ ID NO: 740 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 741 - protein, 243 aa, synthetic construct
  REGION 1..243: note = Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 742 - protein, 498 aa, synthetic construct
  REGION 1..498: note = Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 743 - protein, 986 aa, synthetic construct
  REGION 1..986: note = Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 744 - protein, 5 aa, synthetic construct
  REGION 1..5: note = Synthetic peptide
SYAMS

SEQ ID NO: 745 - protein, 17 aa, synthetic construct
  REGION 1..17: note = Synthetic peptide
AISGSGGRTFYAESVEG

SEQ ID NO: 746 - protein, 11 aa, synthetic construct
  REGION 1..11: note = Synthetic peptide
HDYSNYPYFDY

SEQ ID NO: 747 - protein, 12 aa, synthetic construct
  REGION 1..12: note = Synthetic peptide
RASQSVRSNYLA

SEQ ID NO: 748 - protein, 7 aa, synthetic construct
  REGION 1..7: note = Synthetic peptide
GASSRAT

SEQ ID NO: 749 - protein, 9 aa, synthetic construct
  REGION 1..9: note = Synthetic peptide
QQYGDLPFT

SEQ ID NO: 750 - protein, 120 aa, synthetic construct; identical to SEQ ID NO: 638
  REGION 1..120: note = Synthetic peptide

SEQ ID NO: 751 - protein, 108 aa, synthetic construct; identical to SEQ ID NO: 719
  REGION 1..108: note = Synthetic peptide

SEQ ID NO: 752 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIK

SEQ ID NO: 753 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 754 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 755 - protein, 120 aa, synthetic construct; identical to SEQ ID NO: 643
  REGION 1..120: note = Synthetic peptide

SEQ ID NO: 756 - protein, 108 aa, synthetic construct; identical to SEQ ID NO: 724
  REGION 1..108: note = Synthetic peptide

SEQ ID NO: 757 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 758 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 759 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 760 - protein, 5 aa, synthetic construct
  REGION 1..5: note = Synthetic peptide
SYAMS

SEQ ID NO: 761 - protein, 17 aa, synthetic construct
  REGION 1..17: note = Synthetic peptide
AISGSGGRTFYAESVEG

SEQ ID NO: 762 - protein, 11 aa, synthetic construct
  REGION 1..11: note = Synthetic peptide
HDYSNYPYFDY

SEQ ID NO: 763 - protein, 12 aa, synthetic construct
  REGION 1..12: note = Synthetic peptide
RASQSVRSSYLA

SEQ ID NO: 764 - protein, 7 aa, synthetic construct
  REGION 1..7: note = Synthetic peptide
GASSRAT

SEQ ID NO: 765 - protein, 9 aa, synthetic construct
  REGION 1..9: note = Synthetic peptide
QQYGSSPFT

SEQ ID NO: 766 - protein, 120 aa, synthetic construct; identical to SEQ ID NO: 638
  REGION 1..120: note = Synthetic peptide

SEQ ID NO: 767 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIK

SEQ ID NO: 768 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIK

SEQ ID NO: 769 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 770 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 771 - protein, 120 aa, synthetic construct; identical to SEQ ID NO: 643
  REGION 1..120: note = Synthetic peptide

SEQ ID NO: 772 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 773 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 774 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 775 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 776 - protein, 5 aa, synthetic construct
  REGION 1..5: note = Synthetic peptide
SYAMS

SEQ ID NO: 777 - protein, 17 aa, synthetic construct
  REGION 1..17: note = Synthetic peptide
AISGSGGSTFYAESVQG

SEQ ID NO: 778 - protein, 11 aa, synthetic construct
  REGION 1..11: note = Synthetic peptide
HDYSNYPYFDY

SEQ ID NO: 779 - protein, 12 aa, synthetic construct
  REGION 1..12: note = Synthetic peptide
RASQSVRGNYLA

SEQ ID NO: 780 - protein, 7 aa, synthetic construct
  REGION 1..7: note = Synthetic peptide
GASSRAT

SEQ ID NO: 781 - protein, 9 aa, synthetic construct
  REGION 1..9: note = Synthetic peptide
QQYGYSPFT

SEQ ID NO: 782 - protein, 120 aa, synthetic construct
  REGION 1..120: note = Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSS

SEQ ID NO: 783 - protein, 108 aa, synthetic construct
  REGION 1..108: note = Synthetic peptide
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIK

SEQ ID NO: 784 - protein, 243 aa, synthetic construct
  REGION 1..243: note = Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIK

SEQ ID NO: 785 - protein, 498 aa, synthetic construct
  REGION 1..498: note = Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 786 - protein, 986 aa, synthetic construct
  REGION 1..986: note = Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 787 - protein, 120 aa, synthetic construct
  REGION 1..120: note = Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSS

SEQ ID NO: 788 - protein, 108 aa, synthetic construct
  REGION 1..108: note = Synthetic peptide
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIK

SEQ ID NO: 789 - protein, 243 aa, synthetic construct
  REGION 1..243: note = Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIK

SEQ ID NO: 790 - protein, 498 aa, synthetic construct
  REGION 1..498: note = Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 791 - protein, 986 aa, synthetic construct
  REGION 1..986: note = Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 792 - protein, 5 aa, synthetic construct
  REGION 1..5: note = Synthetic peptide
TYAMS

SEQ ID NO: 793 - protein, 17 aa, synthetic construct
  REGION 1..17: note = Synthetic peptide
AISGSGGGTFYAESVKG

SEQ ID NO: 794 - protein, 11 aa, synthetic construct
  REGION 1..11: note = Synthetic peptide
HDYSNYPYFDY

SEQ ID NO: 795 - protein, 12 aa, synthetic construct
  REGION 1..12: note = Synthetic peptide
RASQSIRSNYLA

SEQ ID NO: 796 - protein, 7 aa, synthetic construct
  REGION 1..7: note = Synthetic peptide
GASSRAT

SEQ ID NO: 797 - protein, 9 aa, synthetic construct
  REGION 1..9: note = Synthetic peptide
QQYGSSPFT

SEQ ID NO: 798 - protein, 120 aa, synthetic construct
  REGION 1..120: note = Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSS

SEQ ID NO: 799 - protein, 108 aa, synthetic construct
  REGION 1..108: note = Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIK

SEQ ID NO: 800 - protein, 243 aa, synthetic construct
  REGION 1..243: note = Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIK

SEQ ID NO: 801 - protein, 498 aa, synthetic construct
  REGION 1..498: note = Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 802 - protein, 986 aa, synthetic construct
  REGION 1..986: note = Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 803 - protein, 120 aa, synthetic construct
  REGION 1..120: note = Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSS

SEQ ID NO: 804 - protein, 108 aa, synthetic construct
  REGION 1..108: note = Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 805 - protein, 243 aa, synthetic construct
  REGION 1..243: note = Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 806 - protein, 498 aa, synthetic construct
  REGION 1..498: note = Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 807 - protein, 986 aa, synthetic construct
  REGION 1..986: note = Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 808 - protein, 5 aa, synthetic construct
  REGION 1..5: note = Synthetic peptide
TYAMS

SEQ ID NO: 809 - protein, 17 aa, synthetic construct
  REGION 1..17: note = Synthetic peptide
LISGSGGRTYYAESVKG

SEQ ID NO: 810 - protein, 11 aa, synthetic construct
  REGION 1..11: note = Synthetic peptide
HDYSNYPYFDY

SEQ ID NO: 811 - protein, 12 aa, synthetic construct
  REGION 1..12: note = Synthetic peptide
RASQSVRSNYLA

SEQ ID NO: 812 - protein, 7 aa, synthetic construct
  REGION 1..7: note = Synthetic peptide
GASNRAT

SEQ ID NO: 813 - protein, 9 aa, synthetic construct
  REGION 1..9: note = Synthetic peptide
QQYGISPPT

SEQ ID NO: 814 - protein, 120 aa, synthetic construct
  REGION 1..120: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSS

SEQ ID NO: 815 - protein, 108 aa, synthetic construct
  REGION 1..108: note = Synthetic peptide
EIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIK

SEQ ID NO: 816 - protein, 243 aa, synthetic construct
  REGION 1..243: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIK

SEQ ID NO: 817 - protein, 498 aa, synthetic construct
  REGION 1..498: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 818 - protein, 986 aa, synthetic construct
  REGION 1..986: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 819 - protein, 120 aa, synthetic construct
  REGION 1..120: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSS

SEQ ID NO: 820 - protein, 108 aa, synthetic construct
  REGION 1..108: note = Synthetic peptide
EIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 821 - protein, 243 aa, synthetic construct
  REGION 1..243: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 822 - protein, 498 aa, synthetic construct
  REGION 1..498: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 823 - protein, 986 aa, synthetic construct
  REGION 1..986: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 824 - protein, 5 aa, synthetic construct
  REGION 1..5: note = Synthetic peptide
SYAMS

SEQ ID NO: 825 - protein, 17 aa, synthetic construct
  REGION 1..17: note = Synthetic peptide
AISGSGGRAQYAESVQG

SEQ ID NO: 826 - protein, 11 aa, synthetic construct
  REGION 1..11: note = Synthetic peptide
HDYSNYPYFDY

SEQ ID NO: 827 - protein, 11 aa, synthetic construct
  REGION 1..11: note = Synthetic peptide
RASQSVSSNLA

SEQ ID NO: 828 - protein, 7 aa, synthetic construct
  REGION 1..7: note = Synthetic peptide
GSSSRAT

SEQ ID NO: 829 - protein, 9 aa, synthetic construct
  REGION 1..9: note = Synthetic peptide
QQYGSSPPP

SEQ ID NO: 830 - protein, 120 aa, synthetic construct
  REGION 1..120: note = Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSS

SEQ ID NO: 831 - protein, 107 aa, synthetic construct
  REGION 1..107: note = Synthetic peptide
EIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIK

SEQ ID NO: 832 - protein, 242 aa, synthetic construct
  REGION 1..242: note = Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIK

SEQ ID NO: 833 - protein, 497 aa, synthetic construct
  REGION 1..497: note = Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 834 - protein, 985 aa, synthetic construct
  REGION 1..985: note = Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 835 - protein, 120 aa, synthetic construct
  REGION 1..120: note = Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSS

SEQ ID NO: 836 - protein, 107 aa, synthetic construct
  REGION 1..107: note = Synthetic peptide
EIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 837 - protein, 242 aa, synthetic construct
  REGION 1..242: note = Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 838 - protein, 497 aa, synthetic construct
  REGION 1..497: note = Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 839 - protein, 985 aa, synthetic construct
  REGION 1..985: note = Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 840 - protein, 5 aa, synthetic construct
  REGION 1..5: note = Synthetic peptide
SYAMS

SEQ ID NO: 841 - protein, 17 aa, synthetic construct
  REGION 1..17: note = Synthetic peptide
AISGSGGRTFYAESVEG

SEQ ID NO: 842 - protein, 11 aa, synthetic construct
  REGION 1..11: note = Synthetic peptide
HDYSNYPYFDY

SEQ ID NO: 843 - protein, 12 aa, synthetic construct
  REGION 1..12: note = Synthetic peptide
RASQGVRSDYLA

SEQ ID NO: 844 - protein, 7 aa, synthetic construct
  REGION 1..7: note = Synthetic peptide
GASSRAT

SEQ ID NO: 845 - protein, 9 aa, synthetic construct
  REGION 1..9: note = Synthetic peptide
QQYGSTPPT

SEQ ID NO: 846 - protein, 120 aa, synthetic construct
  REGION 1..120: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSS

SEQ ID NO: 847 - protein, 108 aa, synthetic construct
  REGION 1..108: note = Synthetic peptide
EIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIK

SEQ ID NO: 848 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIK

SEQ ID NO: 849 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 850 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 851 - protein, 120 aa, synthetic construct
  REGION 1..120: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSS

SEQ ID NO: 852 - protein, 108 aa, synthetic construct
  REGION 1..108: note = Synthetic peptide
EIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 853 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 854 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 855 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 856 - protein, 5 aa, synthetic construct
  REGION 1..5: note = Synthetic peptide
SYAMS

SEQ ID NO: 857 - protein, 17 aa, synthetic construct
  REGION 1..17: note = Synthetic peptide
AIGEGGGYTYYAESVKG

SEQ ID NO: 858 - protein, 11 aa, synthetic construct
  REGION 1..11: note = Synthetic peptide
HDYSNYPYFDY

SEQ ID NO: 859 - protein, 12 aa, synthetic construct
  REGION 1..12: note = Synthetic peptide
RASQGVRSSYFA

SEQ ID NO: 860 - protein, 7 aa, synthetic construct
  REGION 1..7: note = Synthetic peptide
GASTRAT

SEQ ID NO: 861 - protein, 9 aa, synthetic construct
  REGION 1..9: note = Synthetic peptide
QQYGSSPPT

SEQ ID NO: 862 - protein, 119 aa, synthetic construct
  REGION 1..119: note = Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVS

SEQ ID NO: 863 - protein, 108 aa, synthetic construct
  REGION 1..108: note = Synthetic peptide
EIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIK

SEQ ID NO: 864 - protein, 243 aa, synthetic construct
  REGION 1..243: note = Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIK

SEQ ID NO: 865 - protein, 498 aa, synthetic construct
  REGION 1..498: note = Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 866 - protein, 986 aa, synthetic construct
  REGION 1..986: note = Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 867 - protein, 120 aa, synthetic construct
  REGION 1..120: note = Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSS

SEQ ID NO: 868 - protein, 108 aa, synthetic construct
  REGION 1..108: note = Synthetic peptide
EIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 869 - protein, 243 aa, synthetic construct
  REGION 1..243: note = Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 870 - protein, 498 aa, synthetic construct
  REGION 1..498: note = Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 871 - protein, 986 aa, synthetic construct
  REGION 1..986: note = Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 872 - protein, 5 aa, synthetic construct
  REGION 1..5: note = Synthetic peptide
SYAMS

SEQ ID NO: 873 - protein, 17 aa, synthetic construct
  REGION 1..17: note = Synthetic peptide
AISGSGGRTFYAESVEG

SEQ ID NO: 874 - protein, 11 aa, synthetic construct
  REGION 1..11: note = Synthetic peptide
HDYSNYPYFDY

SEQ ID NO: 875 - protein, 12 aa, synthetic construct
  REGION 1..12: note = Synthetic peptide
RASQSIRSNYLA

SEQ ID NO: 876 - protein, 7 aa, synthetic construct
  REGION 1..7: note = Synthetic peptide
GASSRAT

SEQ ID NO: 877 - protein, 9 aa, synthetic construct
  REGION 1..9: note = Synthetic peptide
QQYGSSPPS

SEQ ID NO: 878 - protein, 120 aa, synthetic construct
  REGION 1..120: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 879 - protein, 108 aa, synthetic construct
  REGION 1..108: note = Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIK

SEQ ID NO: 880 - protein, 243 aa, synthetic construct
  REGION 1..243: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIK

SEQ ID NO: 881 - protein, 498 aa, synthetic construct
  REGION 1..498: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 882 - protein, 986 aa, synthetic construct
  REGION 1..986: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 883 - protein, 120 aa, synthetic construct
  REGION 1..120: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 884 - protein, 108 aa, synthetic construct
  REGION 1..108: note = Synthetic peptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 885 - protein, 243 aa, synthetic construct
  REGION 1..243: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 886 - protein, 498 aa, synthetic construct
  REGION 1..498: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 887 - protein, 986 aa, synthetic construct
  REGION 1..986: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 888 - protein, 5 aa, synthetic construct
  REGION 1..5: note = Synthetic peptide
SYAMS

SEQ ID NO: 889 - protein, 17 aa, synthetic construct
  REGION 1..17: note = Synthetic peptide
AISGSGGGTFYAESVEG

SEQ ID NO: 890 - protein, 11 aa, synthetic construct
  REGION 1..11: note = Synthetic peptide
HDYSNYPYFDY

SEQ ID NO: 891 - protein, 12 aa, synthetic construct
  REGION 1..12: note = Synthetic peptide
RASQSVRSSYLA

SEQ ID NO: 892 - protein, 7 aa, synthetic construct
  REGION 1..7: note = Synthetic peptide
GASSRAT

SEQ ID NO: 893 - protein, 9 aa, synthetic construct
  REGION 1..9: note = Synthetic peptide
QQYGDLPFT

SEQ ID NO: 894 - protein, 120 aa, synthetic construct
  REGION 1..120: note = Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSS

SEQ ID NO: 895 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIK

SEQ ID NO: 896 - protein, 243 aa, synthetic construct
  REGION 1..243: note = Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIK

SEQ ID NO: 897 - protein, 498 aa, synthetic construct
  REGION 1..498: note = Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 898 - protein, 986 aa, synthetic construct
  REGION 1..986: note = Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 899 - protein, 120 aa, synthetic construct
  REGION 1..120: note = Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSS

SEQ ID NO: 900 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 901 - protein, 243 aa, synthetic construct
  REGION 1..243: note = Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 902 - protein, 498 aa, synthetic construct
  REGION 1..498: note = Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 903 - protein, 986 aa, synthetic construct
  REGION 1..986: note = Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 904 - protein, 5 aa, synthetic construct
  REGION 1..5: note = Synthetic peptide
SYAMS

SEQ ID NO: 905 - protein, 17 aa, synthetic construct
  REGION 1..17: note = Synthetic peptide
AISGSGGRTFYAESVEG

SEQ ID NO: 906 - protein, 11 aa, synthetic construct
  REGION 1..11: note = Synthetic peptide
HDYSNYPYFDY

SEQ ID NO: 907 - protein, 12 aa, synthetic construct
  REGION 1..12: note = Synthetic peptide
RASQSVRSSYLA

SEQ ID NO: 908 - protein, 7 aa, synthetic construct
  REGION 1..7: note = Synthetic peptide
GASSRAT

SEQ ID NO: 909 - protein, 9 aa, synthetic construct
  REGION 1..9: note = Synthetic peptide
QQYGDLPFT

SEQ ID NO: 910 - protein, 120 aa, synthetic construct; identical to SEQ ID NO: 846
  REGION 1..120: note = Synthetic peptide

SEQ ID NO: 911 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK

SEQ ID NO: 912 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIK

SEQ ID NO: 913 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 914 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 915 - protein, 120 aa, synthetic construct; identical to SEQ ID NO: 851
  REGION 1..120: note = Synthetic peptide

SEQ ID NO: 916 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 917 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 918 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 919 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 920 - protein, 5 aa, synthetic construct
  REGION 1..5: note = Synthetic peptide
TYAMS

SEQ ID NO: 921 - protein, 17 aa, synthetic construct
  REGION 1..17: note = Synthetic peptide
LISGSGGRTYYAESVKG

SEQ ID NO: 922 - protein, 11 aa, synthetic construct
  REGION 1..11: note = Synthetic peptide
HDYSNYPYFDY

SEQ ID NO: 923 - protein, 12 aa, synthetic construct
  REGION 1..12: note = Synthetic peptide
RASQGVRSSYLA

SEQ ID NO: 924 - protein, 7 aa, synthetic construct
  REGION 1..7: note = Synthetic peptide
GASSRAT

SEQ ID NO: 925 - protein, 9 aa, synthetic construct
  REGION 1..9: note = Synthetic peptide
QQYGSSPPT

SEQ ID NO: 926 - protein, 120 aa, synthetic construct; identical to SEQ ID NO: 814
  REGION 1..120: note = Synthetic peptide

SEQ ID NO: 927 - protein, 108 aa, synthetic construct
  REGION 1..108: note = Synthetic peptide
EIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIK

SEQ ID NO: 928 - protein, 243 aa, synthetic construct
  REGION 1..243: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIK

SEQ ID NO: 929 - protein, 498 aa, synthetic construct
  REGION 1..498: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 930 - protein, 986 aa, synthetic construct
  REGION 1..986: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 931 - protein, 120 aa, synthetic construct; identical to SEQ ID NO: 819
  REGION 1..120: note = Synthetic peptide

SEQ ID NO: 932 - protein, 108 aa, synthetic construct
  REGION 1..108: note = Synthetic peptide
EIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 933 - protein, 243 aa, synthetic construct
  REGION 1..243: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 934 - protein, 498 aa, synthetic construct
  REGION 1..498: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 935 - protein, 986 aa, synthetic construct
  REGION 1..986: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 936 - protein, 5 aa, synthetic construct
  REGION 1..5: note = Synthetic peptide
SYAMS

SEQ ID NO: 937 - protein, 17 aa, synthetic construct
  REGION 1..17: note = Synthetic peptide
AISGSGGRTFYAESVEG

SEQ ID NO: 938 - protein, 11 aa, synthetic construct
  REGION 1..11: note = Synthetic peptide
HDYSNYPYFDY

SEQ ID NO: 939 - protein, 12 aa, synthetic construct
  REGION 1..12: note = Synthetic peptide
RASQSVRSNYLA

SEQ ID NO: 940 - protein, 7 aa, synthetic construct
  REGION 1..7: note = Synthetic peptide
GASSRAT

SEQ ID NO: 941 - protein, 9 aa, synthetic construct
  REGION 1..9: note = Synthetic peptide
QQYGSSPPT

SEQ ID NO: 942 - protein, 120 aa, synthetic construct; identical to SEQ ID NO: 878
  REGION 1..120: note = Synthetic peptide

SEQ ID NO: 943 - protein, 108 aa, synthetic construct
  REGION 1..108: note = Synthetic peptide
EIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIK

SEQ ID NO: 944 - protein, 243 aa, synthetic construct
  REGION 1..243: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIK

SEQ ID NO: 945 - protein, 498 aa, synthetic construct
  REGION 1..498: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 946 - protein, 986 aa, synthetic construct
  REGION 1..986: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 947 - protein, 120 aa, synthetic construct; identical to SEQ ID NO: 883
  REGION 1..120: note = Synthetic peptide

SEQ ID NO: 948 - protein, 108 aa, synthetic construct
  REGION 1..108: note = Synthetic peptide
EIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 949 - protein, 243 aa, synthetic construct
  REGION 1..243: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 950 - protein, 498 aa, synthetic construct
  REGION 1..498: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 951 - protein, 986 aa, synthetic construct
  REGION 1..986: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 952 - protein, 5 aa, synthetic construct
  REGION 1..5: note = Synthetic peptide
SYAMS

SEQ ID NO: 953 - protein, 17 aa, synthetic construct
  REGION 1..17: note = Synthetic peptide
VISGSGGITDFAESVKG

SEQ ID NO: 954 - protein, 11 aa, synthetic construct
  REGION 1..11: note = Synthetic peptide
HDYSNYFFFDY

SEQ ID NO: 955 - protein, 11 aa, synthetic construct
  REGION 1..11: note = Synthetic peptide
RASQGISNYLA

SEQ ID NO: 956 - protein, 7 aa, synthetic construct
  REGION 1..7: note = Synthetic peptide
AASILQS

SEQ ID NO: 957 - protein, 9 aa, synthetic construct
  REGION 1..9: note = Synthetic peptide
QQYFAYPIT

SEQ ID NO: 958 - protein, 120 aa, synthetic construct
  REGION 1..120: note = Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSS

SEQ ID NO: 959 - protein, 107 aa, synthetic construct
  REGION 1..107: note = Synthetic peptide
DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 960 - protein, 242 aa, synthetic construct
  REGION 1..242: note = Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 961 - protein, 497 aa, synthetic construct
  REGION 1..497: note = Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 962 - protein, 985 aa, synthetic construct
  REGION 1..985: note = Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 963 - protein, 120 aa, synthetic construct
  REGION 1..120: note = Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSS

SEQ ID NO: 964 - protein, 107 aa, synthetic construct
  REGION 1..107: note = Synthetic peptide
DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 965 - protein, 242 aa, synthetic construct
  REGION 1..242: note = Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 966 - protein, 497 aa, synthetic construct
  REGION 1..497: note = Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 967 - protein, 985 aa, synthetic construct
  REGION 1..985: note = Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 968 - protein, 5 aa, synthetic construct
  REGION 1..5: note = Synthetic peptide
SYAMS

SEQ ID NO: 969 - protein, 17 aa, synthetic construct
  REGION 1..17: note = Synthetic peptide
AISGSGGRTFYAESVEG

SEQ ID NO: 970 - protein, 11 aa, synthetic construct
  REGION 1..11: note = Synthetic peptide
HDYSNYPYFDY

SEQ ID NO: 971 - protein, 12 aa, synthetic construct
  REGION 1..12: note = Synthetic peptide
RASQSVRSSYLA

SEQ ID NO: 972 - protein, 7 aa, synthetic construct
  REGION 1..7: note = Synthetic peptide
GASSRAT

SEQ ID NO: 973 - protein, 9 aa, synthetic construct
  REGION 1..9: note = Synthetic peptide
QQYGSSPPT

SEQ ID NO: 974 - protein, 120 aa, synthetic construct; identical to SEQ ID NO: 638
  REGION 1..120: note = Synthetic peptide

SEQ ID NO: 975 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIK

SEQ ID NO: 976 - protein, 243 aa, synthetic construct
  REGION 1..243: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIK

SEQ ID NO: 977 - protein, 498 aa, synthetic construct
  REGION 1..498: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 978 - protein, 986 aa, synthetic construct
  REGION 1..986: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 979 - protein, 120 aa, synthetic construct; identical to SEQ ID NO: 643
  REGION 1..120: note = Synthetic peptide

SEQ ID NO: 980 - protein, 108 aa, synthetic construct
  REGION 1..108: note = Synthetic peptide
EIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 981 - protein, 243 aa, synthetic construct
  REGION 1..243: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 982 - protein, 498 aa, synthetic construct
  REGION 1..498: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 983 - protein, 986 aa, synthetic construct
  REGION 1..986: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 984 - protein, 5 aa, synthetic construct
  REGION 1..5: note = Synthetic peptide
IYAMS

SEQ ID NO: 985 - protein, 17 aa, synthetic construct
  REGION 1..17: note = Synthetic peptide
AIGGSGGSTFYAESVKG

SEQ ID NO: 986 - protein, 11 aa, synthetic construct
  REGION 1..11: note = Synthetic peptide
HDYSNYPYFDY

SEQ ID NO: 987 - protein, 12 aa, synthetic construct
  REGION 1..12: note = Synthetic peptide
RASQSVRSSYVA

SEQ ID NO: 988 - protein, 7 aa, synthetic construct
  REGION 1..7: note = Synthetic peptide
GASSRAT

SEQ ID NO: 989 - protein, 9 aa, synthetic construct
  REGION 1..9: note = Synthetic peptide
QQYGDLPFT

SEQ ID NO: 990 - protein, 120 aa, synthetic construct
  REGION 1..120: note = Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSS

SEQ ID NO: 991 - protein, 108 aa, synthetic construct
  REGION 1..108: note = Synthetic peptide
EIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIK

SEQ ID NO: 992 - protein, 243 aa, synthetic construct
  REGION 1..243: note = Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIK

SEQ ID NO: 993 - protein, 498 aa, synthetic construct
  REGION 1..498: note = Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 994 - protein, 986 aa, synthetic construct
  REGION 1..986: note = Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 995 - protein, 120 aa, synthetic construct
  REGION 1..120: note = Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSS

SEQ ID NO: 996 - protein, 108 aa, synthetic construct
  REGION 1..108: note = Synthetic peptide
EIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 997 - protein, 243 aa, synthetic construct
  REGION 1..243: note = Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 998 - protein, 498 aa, synthetic construct
  REGION 1..498: note = Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 999 - protein, 986 aa, synthetic construct
  REGION 1..986: note = Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1000 - protein, 7 aa, synthetic construct
  REGION 1..7: note = Synthetic peptide
SSSYYWG

SEQ ID NO: 1001 - protein, 16 aa, synthetic construct
  REGION 1..16: note = Synthetic peptide
SIYHSGGTYFNPSLKS

SEQ ID NO: 1002 - protein, 15 aa, synthetic construct
  REGION 1..15: note = Synthetic peptide
HYEILTGYYPDVFDI

SEQ ID NO: 1003 - protein, 11 aa, synthetic construct
  REGION 1..11: note = Synthetic peptide
RASQSISSYLN

SEQ ID NO: 1004 - protein, 7 aa, synthetic construct
  REGION 1..7: note = Synthetic peptide
AASNLQS

SEQ ID NO: 1005 - protein, 9 aa, synthetic construct
  REGION 1..9: note = Synthetic peptide
QQSFSSPRT

SEQ ID NO: 1006 - protein, 125 aa, synthetic construct
  REGION 1..125: note = Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSS

SEQ ID NO: 1007 - protein, 107 aa, synthetic construct
  REGION 1..107: note = Synthetic peptide
DIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIK

SEQ ID NO: 1008 - protein, 247 aa, synthetic construct
  REGION 1..247: note = Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIK

SEQ ID NO: 1009 - protein, 502 aa, synthetic construct
  REGION 1..502: note = Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1010 - protein, 990 aa, synthetic construct
  REGION 1..990: note = Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1011 - protein, 125 aa, synthetic construct
  REGION 1..125: note = Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSS

SEQ ID NO: 1012 - protein, 107 aa, synthetic construct
  REGION 1..107: note = Synthetic peptide
DIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIK

SEQ ID NO: 1013 - protein, 247 aa, synthetic construct
  REGION 1..247: note = Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIK

SEQ ID NO: 1014 - protein, 502 aa, synthetic construct [sequence omitted]

SEQ ID NO: 1015 - protein, 990 aa, synthetic construct
  REGION 1..990: note = Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1016 - protein, 5 aa, synthetic construct
  REGION 1..5: note = Synthetic peptide
SYSMN

SEQ ID NO: 1017 - protein, 17 aa, synthetic construct
  REGION 1..17: note = Synthetic peptide
YISSSGGYIYYAESVKG

SEQ ID NO: 1018 - protein, 11 aa, synthetic construct
  REGION 1..11: note = Synthetic peptide
GDYSNYAYFDY

SEQ ID NO: 1019 - protein, 11 aa, synthetic construct
  REGION 1..11: note = Synthetic peptide
RASQGISNYLA

SEQ ID NO: 1020 - protein, 7 aa, synthetic construct
  REGION 1..7: note = Synthetic peptide
AASTLQS

SEQ ID NO: 1021 - protein, 9 aa, synthetic construct
  REGION 1..9: note = Synthetic peptide
QQYYSTPLT

SEQ ID NO: 1022 - protein, 120 aa, synthetic construct
  REGION 1..120: note = Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSS

SEQ ID NO: 1023 - protein, 107 aa, synthetic construct
  REGION 1..107: note = Synthetic peptide
DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 1024 - protein, 242 aa, synthetic construct
  REGION 1..242: note = Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 1025 - protein, 497 aa, synthetic construct
  REGION 1..497: note = Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1026 - protein, 985 aa, synthetic construct
  REGION 1..985: note = Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1027 - protein, 120 aa, synthetic construct
  REGION 1..120: note = Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSS

SEQ ID NO: 1028 - protein, 107 aa, synthetic construct
  REGION 1..107: note = Synthetic peptide
DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 1029 - protein, 242 aa, synthetic construct
  REGION 1..242: note = Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 1030 - protein, 497 aa, synthetic construct
  REGION 1..497: note = Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1031 - protein, 985 aa, synthetic construct
  REGION 1..985: note = Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1032 - protein, 5 aa, synthetic construct
  REGION 1..5: note = Synthetic peptide
VYAMS

SEQ ID NO: 1033 - protein, 17 aa, synthetic construct
  REGION 1..17: note = Synthetic peptide
TISGSGGSTFYAESVKG

SEQ ID NO: 1034 - protein, 11 aa, synthetic construct
  REGION 1..11: note = Synthetic peptide
HDYSNYAYFDY

SEQ ID NO: 1035 - protein, 12 aa, synthetic construct
  REGION 1..12: note = Synthetic peptide
RASQSVRSSYLA

SEQ ID NO: 1036 - protein, 7 aa, synthetic construct
  REGION 1..7: note = Synthetic peptide
GASSRAT

SEQ ID NO: 1037 - protein, 9 aa, synthetic construct
  REGION 1..9: note = Synthetic peptide
QQYGDLPFT

SEQ ID NO: 1038 - protein, 120 aa, synthetic construct
  REGION 1..120: note = Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSS

SEQ ID NO: 1039 - protein, 108 aa, synthetic construct; identical to SEQ ID NO: 735
  REGION 1..108: note = Synthetic peptide

SEQ ID NO: 1040 - protein, 243 aa, synthetic construct
  REGION 1..243: note = Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 1041 - protein, 498 aa, synthetic construct
  REGION 1..498: note = Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1042 - protein, 986 aa, synthetic construct
  REGION 1..986: note = Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1043 - protein, 120 aa, synthetic construct
  REGION 1..120: note = Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSS

SEQ ID NO: 1044 - protein, 108 aa, synthetic construct; identical to SEQ ID NO: 740
  REGION 1..108: note = Synthetic peptide

SEQ ID NO: 1045 - protein, 243 aa, synthetic construct
  REGION 1..243: note = Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 1046 - protein, 498 aa, synthetic construct
  REGION 1..498: note = Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1047 - protein, 986 aa, synthetic construct
  REGION 1..986: note = Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1048 - protein, 5 aa, synthetic construct
  REGION 1..5: note = Synthetic peptide
SYGMH

SEQ ID NO: 1049 - protein, 17 aa, synthetic construct
  REGION 1..17: note = Synthetic peptide
VISYEGSNKYYAESVKG

SEQ ID NO: 1050 - protein, 15 aa, synthetic construct
  REGION 1..15: note = Synthetic peptide
GRYYGSGNYNHGMDV

SEQ ID NO: 1051 - protein, 11 aa, synthetic construct
  REGION 1..11: note = Synthetic peptide
RASQSISSYLN

SEQ ID NO: 1052 - protein, 7 aa, synthetic construct
  REGION 1..7: note = Synthetic peptide
AASSLQS

SEQ ID NO: 1053 - protein, 9 aa, synthetic construct
  REGION 1..9: note = Synthetic peptide
QQSYSTPFT

SEQ ID NO: 1054 - protein, 124 aa, synthetic construct
  REGION 1..124: note = Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSS

SEQ ID NO: 1055 - protein, 107 aa, synthetic construct
  REGION 1..107: note = Synthetic peptide
DIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 1056 - protein, 246 aa, synthetic construct
  REGION 1..246: note = Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 1057 - protein, 501 aa, synthetic construct
  REGION 1..501: note = Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1058 - protein, 989 aa, synthetic construct
  REGION 1..989: note = Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1059 - protein, 124 aa, synthetic construct
  REGION 1..124: note = Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSS

SEQ ID NO: 1060 - protein, 107 aa, synthetic construct
  REGION 1..107: note = Synthetic peptide
DIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 1061 - protein, 246 aa, synthetic construct
  REGION 1..246: note = Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 1062 - protein, 501 aa, synthetic construct
  REGION 1..501: note = Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1063 - protein, 989 aa, synthetic construct
  REGION 1..989: note = Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1064 - protein, 5 aa, synthetic construct
  REGION 1..5: note = Synthetic peptide
SYGMH

SEQ ID NO: 1065 - protein, 17 aa, synthetic construct
  REGION 1..17: note = Synthetic peptide
VTWYDASNKYYGDAVKG

SEQ ID NO: 1066 - protein, 13 aa, synthetic construct
  REGION 1..13: note = Synthetic peptide
DLLRGVKGYAMDV

SEQ ID NO: 1067 - protein, 12 aa, synthetic construct
  REGION 1..12: note = Synthetic peptide
RASQSLRRIYLA

SEQ ID NO: 1068 - protein, 7 aa, synthetic construct
  REGION 1..7: note = Synthetic peptide
DVFDRAT

SEQ ID NO: 1069 - protein, 9 aa, synthetic construct
  REGION 1..9: note = Synthetic peptide
QQYSESPFT

SEQ ID NO: 1070 - protein, 122 aa, synthetic construct
  REGION 1..122: note = Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSS

SEQ ID NO: 1071 - protein, 108 aa, synthetic construct
  REGION 1..108: note = Synthetic peptide
EIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIK

SEQ ID NO: 1072 - protein, 245 aa, synthetic construct
  REGION 1..245: note = Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIK

SEQ ID NO: 1073 - protein, 500 aa, synthetic construct
  REGION 1..500: note = Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1074 - protein, 988 aa, synthetic construct
  REGION 1..988: note = Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1075 - protein, 122 aa, synthetic construct
  REGION 1..122: note = Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSS

SEQ ID NO: 1076 - protein, 108 aa, synthetic construct
  REGION 1..108: note = Synthetic peptide
EIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIK

SEQ ID NO: 1077 - protein, 245 aa, synthetic construct
  REGION 1..245: note = Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIK

SEQ ID NO: 1078 - protein, 500 aa, synthetic construct
  REGION 1..500: note = Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1079 - protein, 988 aa, synthetic construct
  REGION 1..988: note = Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1080 - protein, 5 aa, synthetic construct
  REGION 1..5: note = Synthetic peptide
SYGIS

SEQ ID NO: 1081 - protein, 17 aa, synthetic construct
  REGION 1..17: note = Synthetic peptide
WISAYQGYTHYAQKLQG

SEQ ID NO: 1082 - protein, 12 aa, synthetic construct
  REGION 1..12: note = Synthetic peptide
DYGGNDYYGMDV

SEQ ID NO: 1083 - protein, 13 aa, synthetic construct
  REGION 1..13: note = Synthetic peptide
SGSSSNIGINYVY

SEQ ID NO: 1084 - protein, 7 aa, synthetic construct
  REGION 1..7: note = Synthetic peptide
RSDQRPS

SEQ ID NO: 1085 - protein, 11 aa, synthetic construct
  REGION 1..11: note = Synthetic peptide
AAFDESLSGVV

SEQ ID NO: 1086 - protein, 121 aa, synthetic construct
  REGION 1..121: note = Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSS

SEQ ID NO: 1087 - protein, 110 aa, synthetic construct
  REGION 1..110: note = Synthetic peptide
QSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVL

SEQ ID NO: 1088 - protein, 246 aa, synthetic construct
  REGION 1..246: note = Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVL

SEQ ID NO: 1089 - protein, 501 aa, synthetic construct
  REGION 1..501: note = Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1090 - protein, 989 aa, synthetic construct
  REGION 1..989: note = Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1091 - protein, 121 aa, synthetic construct
  REGION 1..121: note = Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSS

SEQ ID NO: 1092 - protein, 110 aa, synthetic construct
  REGION 1..110: note = Synthetic peptide
QSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVL

SEQ ID NO: 1093 - protein, 246 aa, synthetic construct
  REGION 1..246: note = Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVL

SEQ ID NO: 1094 - protein, 501 aa, synthetic construct
  REGION 1..501: note = Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1095 - protein, 989 aa, synthetic construct
  REGION 1..989: note = Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1096 - protein, 5 aa, synthetic construct
  REGION 1..5: note = Synthetic peptide
YYGMH

SEQ ID NO: 1097 - protein, 17 aa, synthetic construct
  REGION 1..17: note = Synthetic peptide
VIWYDASNKYYADAVKG

SEQ ID NO: 1098 - protein, 12 aa, synthetic construct
  REGION 1..12: note = Synthetic peptide
DREMGSRGDFDY

SEQ ID NO: 1099 - protein, 11 aa, synthetic construct
  REGION 1..11: note = Synthetic peptide
RASQGINNYLA

SEQ ID NO: 1100 - protein, 7 aa, synthetic construct
  REGION 1..7: note = Synthetic peptide
AVSILQS

SEQ ID NO: 1101 - protein, 9 aa, synthetic construct
  REGION 1..9: note = Synthetic peptide
QQYNFYPFS

SEQ ID NO: 1102 - protein, 121 aa, synthetic construct
  REGION 1..121: note = Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSS

SEQ ID NO: 1103 - protein, 107 aa, synthetic construct
  REGION 1..107: note = Synthetic peptide
DIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIK

SEQ ID NO: 1104 - protein, 243 aa, synthetic construct
  REGION 1..243: note = Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIK

SEQ ID NO: 1105 - protein, 498 aa, synthetic construct
  REGION 1..498: note = Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1106 - protein, 986 aa, synthetic construct
  REGION 1..986: note = Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1107 - protein, 121 aa, synthetic construct
  REGION 1..121: note = Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSS

SEQ ID NO: 1108 - protein, 107 aa, synthetic construct
  REGION 1..107: note = Synthetic peptide
DIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIK

SEQ ID NO: 1109 - protein, 243 aa, synthetic construct
  REGION 1..243: note = Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIK

SEQ ID NO: 1110 - protein, 498 aa, synthetic construct
  REGION 1..498: note = Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1111 - protein, 986 aa, synthetic construct
  REGION 1..986: note = Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1112 - protein, 5 aa, synthetic construct
  REGION 1..5: note = Synthetic peptide
GFYWS

SEQ ID NO: 1113 - protein, 16 aa, synthetic construct
  REGION 1..16: note = Synthetic peptide
EIYHSGHATNNPSLKS

SEQ ID NO: 1114 - protein, 10 aa, synthetic construct
  REGION 1..10: note = Synthetic peptide
GGNSGYIFDY

SEQ ID NO: 1115 - protein, 11 aa, synthetic construct
  REGION 1..11: note = Synthetic peptide
RTSQYIGRYLN

SEQ ID NO: 1116 - protein, 7 aa, synthetic construct
  REGION 1..7: note = Synthetic peptide
GASTLQQ

SEQ ID NO: 1117 - protein, 9 aa, synthetic construct
  REGION 1..9: note = Synthetic peptide
QQTYSTPRT

SEQ ID NO: 1118 - protein, 118 aa, synthetic construct
  REGION 1..118: note = Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSS

SEQ ID NO: 1119 - protein, 107 aa, synthetic construct
  REGION 1..107: note = Synthetic peptide
DVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIK

SEQ ID NO: 1120 - protein, 240 aa, synthetic construct
  REGION 1..240: note = Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIK

SEQ ID NO: 1121 - protein, 495 aa, synthetic construct
  REGION 1..495: note = Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1122 - protein, 983 aa, synthetic construct
  REGION 1..983: note = Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1123 - protein, 118 aa, synthetic construct
  REGION 1..118: note = Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSS

SEQ ID NO: 1124 - protein, 107 aa, synthetic construct
  REGION 1..107: note = Synthetic peptide
DVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIK

SEQ ID NO: 1125 - protein, 240 aa, synthetic construct
  REGION 1..240: note = Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIK

SEQ ID NO: 1126 - protein, 495 aa, synthetic construct
  REGION 1..495: note = Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1127 - protein, 983 aa, synthetic construct
  REGION 1..983: note = Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1128 - protein, 5 aa, synthetic construct
  REGION 1..5: note = Synthetic peptide
TYGMH

SEQ ID NO: 1129 - protein, 17 aa, synthetic construct
  REGION 1..17: note = Synthetic peptide
VIWYEGSNKYYGESVKG

SEQ ID NO: 1130 - protein, 11 aa, synthetic construct
  REGION 1..11: note = Synthetic peptide
DNSHYYYGMDV

SEQ ID NO: 1131 - protein, 14 aa, synthetic construct
  REGION 1..14: note = Synthetic peptide
TGSSSNIGAGYDVN

SEQ ID NO: 1132 - protein, 7 aa, synthetic construct
  REGION 1..7: note = Synthetic peptide
VNNNRPS

SEQ ID NO: 1133 - protein, 11 aa, synthetic construct
  REGION 1..11: note = Synthetic peptide
QSYDTSLSASV

SEQ ID NO: 1134 - protein, 120 aa, synthetic construct
  REGION 1..120: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSS

SEQ ID NO: 1135 - protein, 111 aa, synthetic construct
  REGION 1..111: note = Synthetic peptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVL

SEQ ID NO: 1136 - protein, 246 aa, synthetic construct
  REGION 1..246: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVL

SEQ ID NO: 1137 - protein, 501 aa, synthetic construct
  REGION 1..501: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1138 - protein, 989 aa, synthetic construct
  REGION 1..989: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1139 - protein, 120 aa, synthetic construct
  REGION 1..120: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSS

SEQ ID NO: 1140 - protein, 111 aa, synthetic construct
  REGION 1..111: note = Synthetic peptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVL

SEQ ID NO: 1141 - protein, 246 aa, synthetic construct
  REGION 1..246: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVL

SEQ ID NO: 1142 - protein, 501 aa, synthetic construct
  REGION 1..501: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1143 - protein, 989 aa, synthetic construct
  REGION 1..989: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1144 - protein, 5 aa, synthetic construct
  REGION 1..5: note = Synthetic peptide
TYGMH

SEQ ID NO: 1145 - protein, 17 aa, synthetic construct
  REGION 1..17: note = Synthetic peptide
VIWYEGSNKYYGESVKG

SEQ ID NO: 1146 - protein, 11 aa, synthetic construct
  REGION 1..11: note = Synthetic peptide
DNSHYYYGMDV

SEQ ID NO: 1147 - protein, 14 aa, synthetic construct
  REGION 1..14: note = Synthetic peptide
TGSSSNIGAGYDVN

SEQ ID NO: 1148 - protein, 7 aa, synthetic construct
  REGION 1..7: note = Synthetic peptide
VNNNRPS

SEQ ID NO: 1149 - protein, 11 aa, synthetic construct
  REGION 1..11: note = Synthetic peptide
QSYETSLSASV

SEQ ID NO: 1150 - protein, 120 aa, synthetic construct
  REGION 1..120: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSS

SEQ ID NO: 1151 - protein, 111 aa, synthetic construct
  REGION 1..111: note = Synthetic peptide
QSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVL

SEQ ID NO: 1152 - protein, 246 aa, synthetic construct
  REGION 1..246: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVL

SEQ ID NO: 1153 - protein, 501 aa, synthetic construct
  REGION 1..501: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1154 - protein, 989 aa, synthetic construct
  REGION 1..989: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1155 - protein, 120 aa, synthetic construct
  REGION 1..120: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSS

SEQ ID NO: 1156 - protein, 111 aa, synthetic construct
  REGION 1..111: note = Synthetic peptide
QSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVL

SEQ ID NO: 1157 - protein, 246 aa, synthetic construct
  REGION 1..246: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVL

SEQ ID NO: 1158 - protein, 501 aa, synthetic construct
  REGION 1..501: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1159 - protein, 989 aa, synthetic construct
  REGION 1..989: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1160 - protein, 7 aa, synthetic construct
  REGION 1..7: note = Synthetic peptide
SGVYYWS

SEQ ID NO: 1161 - protein, 16 aa, synthetic construct
  REGION 1..16: note = Synthetic peptide
YIYYSGSTSYNPSLKS

SEQ ID NO: 1162 - protein, 10 aa, synthetic construct
  REGION 1..10: note = Synthetic peptide
SGYSYALFDY

SEQ ID NO: 1163 - protein, 11 aa, synthetic construct
  REGION 1..11: note = Synthetic peptide
RASQSVDRYFN

SEQ ID NO: 1164 - protein, 7 aa, synthetic construct
  REGION 1..7: note = Synthetic peptide
AASSLQS

SEQ ID NO: 1165 - protein, 9 aa, synthetic construct
  REGION 1..9: note = Synthetic peptide
QQSYSTPWT

SEQ ID NO: 1166 - protein, 120 aa, synthetic construct
  REGION 1..120: note = Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSS

SEQ ID NO: 1167 - protein, 107 aa, synthetic construct
  REGION 1..107: note = Synthetic peptide
DIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVK

SEQ ID NO: 1168 - protein, 242 aa, synthetic construct
  REGION 1..242: note = Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVK

SEQ ID NO: 1169 - protein, 497 aa, synthetic construct
  REGION 1..497: note = Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1170 - protein, 985 aa, synthetic construct
  REGION 1..985: note = Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1171 - protein, 120 aa, synthetic construct
  REGION 1..120: note = Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSS

SEQ ID NO: 1172 - protein, 107 aa, synthetic construct
  REGION 1..107: note = Synthetic peptide
DIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVK

SEQ ID NO: 1173 - protein, 242 aa, synthetic construct
  REGION 1..242: note = Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVK

SEQ ID NO: 1174 - protein, 497 aa, synthetic construct
  REGION 1..497: note = Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1175 - protein, 985 aa, synthetic construct
  REGION 1..985: note = Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1176 - protein, 7 aa, synthetic construct
  REGION 1..7: note = Synthetic peptide
SGGYYWS

SEQ ID NO: 1177 - protein, 16 aa, synthetic construct
  REGION 1..16: note = Synthetic peptide
YIFYSGSTDYNPSLKS

SEQ ID NO: 1178 - protein, 10 aa, synthetic construct
  REGION 1..10: note = Synthetic peptide
SGYSYALFDA

SEQ ID NO: 1179 - protein, 11 aa, synthetic construct
  REGION 1..11: note = Synthetic peptide
RASQFIGRYFN

SEQ ID NO: 1180 - protein, 7 aa, synthetic construct
  REGION 1..7: note = Synthetic peptide
AESSLQS

SEQ ID NO: 1181 - protein, 9 aa, synthetic construct
  REGION 1..9: note = Synthetic peptide
QQSYSTPWT

SEQ ID NO: 1182 - protein, 120 aa, synthetic construct
  REGION 1..120: note = Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSS

SEQ ID NO: 1183 - protein, 107 aa, synthetic construct
  REGION 1..107: note = Synthetic peptide
DIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIK

SEQ ID NO: 1184 - protein, 242 aa, synthetic construct
  REGION 1..242: note = Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIK

SEQ ID NO: 1185 - protein, 497 aa, synthetic construct
  REGION 1..497: note = Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1186 - protein, 985 aa, synthetic construct
  REGION 1..985: note = Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1187 - protein, 120 aa, synthetic construct
  REGION 1..120: note = Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSS

SEQ ID NO: 1188 - protein, 107 aa, synthetic construct
  REGION 1..107: note = Synthetic peptide
DIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIK

SEQ ID NO: 1189 - protein, 242 aa, synthetic construct
  REGION 1..242: note = Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIK

SEQ ID NO: 1190 - protein, 497 aa, synthetic construct
  REGION 1..497: note = Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1191 - protein, 985 aa, synthetic construct
  REGION 1..985: note = Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1192 - protein, 984 aa, synthetic construct
  REGION 1..984: note = Synthetic peptide
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1193 - protein, 984 aa, synthetic construct
  REGION 1..984: note = Synthetic peptide
EVQLLESGGGLVQPGGSLRLSCAASGFTFSSYAMSWVRQAPGKGLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1194 - protein, 984 aa, synthetic construct
  REGION 1..984: note = Synthetic peptide
EVQLLESGGGLVQPGGSLKLSCAASGFTFSIYAMSWVRQAPGKCLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1195 - protein, 984 aa, synthetic construct
  REGION 1..984: note = Synthetic peptide
EVQLLESGGGLVQPGGSLKLSCAASGFTFSIYAMSWVRQAPGKGLEWVSAISGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1196 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1197 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1198 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1199 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1200 - protein, 984 aa, synthetic construct
  REGION 1..984: note = Synthetic peptide
EVQLLESGGGLVQSGGSLRLSCAASGFTFSSYAMSWVRQAPGKCLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1201 - protein, 984 aa, synthetic construct
  REGION 1..984: note = Synthetic peptide
EVQLLESGGGLVQSGGSLRLSCAASGFTFSSYAMSWVRQAPGKGLEWVSAISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1202 - protein, 984 aa, synthetic construct
  REGION 1..984: note = Synthetic peptide
EVQLLESGGGLVQPGGSLRLSCAASGFTFSSYAMSWVRQAPGKCLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1203 - protein, 984 aa, synthetic construct
  REGION 1..984: note = Synthetic peptide
EVQLLESGGGLVQPGGSLRLSCAASGFTFSSYAMSWVRQAPGKGLEWVSLISGSGGRTHYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1204 - protein, 984 aa, synthetic construct
  REGION 1..984: note = Synthetic peptide
EVQLLESGGGLVQPGGSLRLSCAASGFTFSTYAMSWVRQAPGKCLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1205 - protein, 984 aa, synthetic construct
  REGION 1..984: note = Synthetic peptide
EVQLLESGGGLVQPGGSLRLSCAASGFTFSTYAMSWVRQAPGKGLEWVSAISGSGGSTFYAESVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1206 - protein, 984 aa, synthetic construct
  REGION 1..984: note = Synthetic peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1207 - protein, 984 aa, synthetic construct
  REGION 1..984: note = Synthetic peptide
EVQLLESGGGMVQPGGSLRLSCAASGFTFSTYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1208 - protein, 984 aa, synthetic construct
  REGION 1..984: note = Synthetic peptide
EVQLLESGGGLVQPGGSLRLSCAASGFTFSSYAMSWVRQAPGKCLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1209 - protein, 984 aa, synthetic construct
  REGION 1..984: note = Synthetic peptide
EVQLLESGGGLVQPGGSLRLSCAASGFTFSSYAMSWVRQAPGKGLEWVSAISGSGGYTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1210 - protein, 984 aa, synthetic construct
  REGION 1..984: note = Synthetic peptide
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1211 - protein, 984 aa, synthetic construct
  REGION 1..984: note = Synthetic peptide
EVQLLESGGGLAQPGGSLRLSCAASGFTFSSYAMSWVRQAPGKGLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1212 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1213 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1214 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1215 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1216 - protein, 984 aa, synthetic construct
  REGION 1..984: note = Synthetic peptide
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1217 - protein, 984 aa, synthetic construct
  REGION 1..984: note = Synthetic peptide
EVQLLESGGGLVQPGGSLRLSCAASGFTFSSYAMSWVRQAPGKGLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1218 - protein, 984 aa, synthetic construct
  REGION 1..984: note = Synthetic peptide
EVQLLESGGGLVQPGGSLRLSCAASGFTFSTYAMSWVRQAPGKCLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1219 - protein, 984 aa, synthetic construct
  REGION 1..984: note = Synthetic peptide
EVQLLESGGGLVQPGGSLRLSCAASGFTFSTYAMSWVRQAPGKGLEWVSAISGSGGGTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1220 - protein, 984 aa, synthetic construct
  REGION 1..984: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1221 - protein, 984 aa, synthetic construct
  REGION 1..984: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1222 - protein, 983 aa, synthetic construct
  REGION 1..983: note = Synthetic peptide
EVQLLESGGGLVQPGGSLRLSCAASGFTFSSYAMSWVRQSPGKCLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1223 - protein, 983 aa, synthetic construct
  REGION 1..983: note = Synthetic peptide
EVQLLESGGGLVQPGGSLRLSCAASGFTFSSYAMSWVRQSPGKGLEWVSAISGSGGRAQYAESVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1224 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1225 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1226 - protein, 984 aa, synthetic construct
  REGION 1..984: note = Synthetic peptide
EVQLLESGGGLVQPGGSLRLSCAASGFTFSSYAMSWVRQAPGKCLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1227 - protein, 984 aa, synthetic construct
  REGION 1..984: note = Synthetic peptide
EVQLLESGGGLVQPGGSLRLSCAASGFTFSSYAMSWVRQAPGKGLEWVSAIGEGGGYTYYAESVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1228 - protein, 984 aa, synthetic construct
  REGION 1..984: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1229 - protein, 984 aa, synthetic construct
  REGION 1..984: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1230 - protein, 984 aa, synthetic construct
  REGION 1..984: note = Synthetic peptide
EVQLLESGGGVVQPGRSLRLSCAASGFTFSSYAMSWVRQAPGKCLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1231 - protein, 984 aa, synthetic construct
  REGION 1..984: note = Synthetic peptide
EVQLLESGGGVVQPGRSLRLSCAASGFTFSSYAMSWVRQAPGKGLEWVSAISGSGGGTFYAESVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1232 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1233 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1234 - protein, 984 aa, synthetic construct
  REGION 1..984: note = Synthetic peptide
EVQLLESGGGLVQPGGSLRLSCAASGFTFSTYAMSWVRQAPGKCLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1235 - protein, 984 aa, synthetic construct
  REGION 1..984: note = Synthetic peptide
EVQLLESGGGLVQPGGSLRLSCAASGFTFSTYAMSWVRQAPGKGLEWVSLISGSGGRTYYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1236 - protein, 984 aa, synthetic construct
  REGION 1..984: note = Synthetic peptide
EVQLLESGGGVVQPGRSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1237 - protein, 984 aa, synthetic construct
  REGION 1..984: note = Synthetic peptide
EVQLLESGGGVVQPGRSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1238 - protein, 983 aa, synthetic construct
  REGION 1..983: note = Synthetic peptide
EVQLLESGGGLVQPGGSLRLSCAASGFTFSSYAMSWVRQAPGKCLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1239 - protein, 983 aa, synthetic construct
  REGION 1..983: note = Synthetic peptide
EVQLLESGGGLVQPGGSLRLSCAASGFTFSSYAMSWVRQAPGKGLEWVSVISGSGGITDFAESVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1240 - protein, 984 aa, synthetic construct
  REGION 1..984: note = Synthetic peptide
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1241 - protein, 984 aa, synthetic construct
  REGION 1..984: note = Synthetic peptide
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1242 - protein, 984 aa, synthetic construct
  REGION 1..984: note = Synthetic peptide
EVQLLESGGGLVQPGGSLRLSCAASGFTFSIYAMSWVRQAPGKCLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1243 - protein, 984 aa, synthetic construct
  REGION 1..984: note = Synthetic peptide
EVQLLESGGGLVQPGGSLRLSCAASGFTFSIYAMSWVRQAPGKGLEWVSAIGGSGGSTFYAESVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1244 - protein, 988 aa, synthetic construct
  REGION 1..988: note = Synthetic peptide
QVQLQESGPGLVKPSQTLSLTCTVSGGSISSSSYYWGWIRQPPGKCLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1245 - protein, 988 aa, synthetic construct
  REGION 1..988: note = Synthetic peptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1246 - protein, 983 aa, synthetic construct
  REGION 1..983: note = Synthetic peptide
EVQLVESGGGLVKPGGSLRLSCAASGFTFSSYSMNWVRQAPGKCLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1247 - protein, 983 aa, synthetic construct
  REGION 1..983: note = Synthetic peptide
EVQLVESGGGLVKPGGSLRLSCAASGFTFSSYSMNWVRQAPGKGLEWVSYISSSGGYIYYAESVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1248 - protein, 984 aa, synthetic construct
  REGION 1..984: note = Synthetic peptide
EVQLLESGGGLVQPGGSLRLSCAASGFTFSVYAMSWVRQAPGKCLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1249 - protein, 984 aa, synthetic construct
  REGION 1..984: note = Synthetic peptide
EVQLLESGGGLVQPGGSLRLSCAASGFTFSVYAMSWVRQAPGKGLEWVSTISGSGGSTFYAESVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1250 - protein, 987 aa, synthetic construct
  REGION 1..987: note = Synthetic peptide
QVQLVESGGGVVQPGRSLRLSCAASGFMFSSYGMHWVRQAPGKCLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1251 - protein, 987 aa, synthetic construct
  REGION 1..987: note = Synthetic peptide
QVQLVESGGGVVQPGRSLRLSCAASGFMFSSYGMHWVRQAPGKGLEWVAVISYEGSNKYYAESVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1252 - protein, 986 aa, synthetic construct
  REGION 1..986: note = Synthetic peptide
QVQLVESGGGVVQPGRSLRLSCAASGFTFSSYGMHWVRQAPGKCLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1253 - protein, 986 aa, synthetic construct
  REGION 1..986: note = Synthetic peptide
QVQLVESGGGVVQPGRSLRLSCAASGFTFSSYGMHWVRQAPGKGLEWVAVTWYDASNKYYGDAVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSESPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1254 - protein, 987 aa, synthetic construct
  REGION 1..987: note = Synthetic peptide
QVQLVQSGAEVKKPGASVKVSCKASGYTFTSYGISWVRQAPGQCLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1255 - protein, 987 aa, synthetic construct
  REGION 1..987: note = Synthetic peptide
QVQLVQSGAEVKKPGASVKVSCKASGYTFTSYGISWVRQAPGQGLEWMGWISAYQGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAFDESLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1256 - protein, 984 aa, synthetic construct
  REGION 1..984: note = Synthetic peptide
QAQLVESGGGVVQPGRSLRLSCAASGFTFSYYGMHWVRQAPGKCLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1257 - protein, 984 aa, synthetic construct
  REGION 1..984: note = Synthetic peptide
QAQLVESGGGVVQPGRSLRLSCAASGFTFSYYGMHWVRQAPGKGLEWVAVIWYDASNKYYADAVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTISNLQPEDFATYYCQQYNFYPFSFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1258 - protein, 981 aa, synthetic construct
  REGION 1..981: note = Synthetic peptide
QVQLQQWGAGLLKPSETLSLTCAVYGGSFSGFYWSWIRQPPGKCLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1259 - protein, 981 aa, synthetic construct
  REGION 1..981: note = Synthetic peptide
QVQLQQWGAGLLKPSETLSLTCAVYGGSFSGFYWSWIRQPPGKGLEWIGEIYHSGHATNNPSLKSRVTISLDTSKNQFSLKLNSVTAADTAVYYCARGGNSGYIFDYWGQGTLVTVSSGGGGSGGGGSGGGGSDVQMTQSPSSLSASVGDRVTITCRTSQYIGRYLNWYQQKPGKAPKVLIYGASTLQQGVPSRFSGSGSGTDFTLTITSLQPEDFASYYCQQTYSTPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1260 - protein, 987 aa, synthetic construct
  REGION 1..987: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1261 - protein, 987 aa, synthetic construct
  REGION 1..987: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1262 - protein, 987 aa, synthetic construct
  REGION 1..987: note = Synthetic peptide
QVQLVESGGGVVQPGRSLRLSCAASGFTFSTYGMHWVRQAPGKCLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1263 - protein, 987 aa, synthetic construct
  REGION 1..987: note = Synthetic peptide
QVQLVESGGGVVQPGRSLRLSCAASGFTFSTYGMHWVRQAPGKGLEWVAVIWYEGSNKYYGESVKGRFTISRDNSKNTLYLQMNSLRAEDTAVYYCARDNSHYYYGMDVWGQGTLVTVSSGGGGSGGGGSGGGGSQSVLTQPPSVSGAPGQRVTISCTGSSSNIGAGYDVNWYQQLPGTAPKLLIYVNNNRPSGVPDRFSGSKSGTSASLAITGLQAEDEADYYCQSYETSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1264 - protein, 983 aa, synthetic construct
  REGION 1..983: note = Synthetic peptide
QMQLQESGPGLVKPSETLSLTCTVSGGSIESGVYYWSWIRQPPGKCLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGCGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1265 - protein, 983 aa, synthetic construct
  REGION 1..983: note = Synthetic peptide
QMQLQESGPGLVKPSETLSLTCTVSGGSIESGVYYWSWIRQPPGKGLEWIGYIYYSGSTSYNPSLKSRLTMSVDTSKNQFSLKLSSVTAADTAVYYCARSGYSYALFDYWGQGTLVTVSSGGGGSGGGGSGGGGSDIQMTQSPSSLSASLGDRVTITCRASQSVDRYFNWYQQKPGKAPKVLIFAASSLQSGVPSRFSGSGSGTDFTLTISSLQPEDFATYYCQQSYSTPWTFGQGTKVEVKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1266 - protein, 983 aa, synthetic construct
  REGION 1..983: note = Synthetic peptide
QVQLQESGPGLVKPSQTLSLTCTVSGDSIISGGYYWSWIRQPPGKCLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1267 - protein, 983 aa, synthetic construct
  REGION 1..983: note = Synthetic peptide
QVQLQESGPGLVKPSQTLSLTCTVSGDSIISGGYYWSWIRQPPGKGLEWIGYIFYSGSTDYNPSLKSRVTISVDTSKNQFSLKLSSVTAADTAVYYCARSGYSYALFDAWGQGTLVTVSSGGGGSGGGGSGGGGSDIQMTQSPSSLSASVGDRVTISCRASQFIGRYFNWYQQKPGKAPKVLIYAESSLQSGVPSRFSGSGSGTEFTLTISSLQPEDFATYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1268 - protein, 501 aa, synthetic construct
  REGION 1..501: note = Synthetic peptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1269 - protein, 5 aa, synthetic construct
  REGION 1..5: note = Synthetic peptide
NYGMH

SEQ ID NO: 1270 - protein, 17 aa, synthetic construct
  REGION 1..17: note = Synthetic peptide
AIGWEGSNKYYAEPVKG

SEQ ID NO: 1271 - protein, 13 aa, synthetic construct
  REGION 1..13: note = Synthetic peptide
DRGTIFGYYGMDV

SEQ ID NO: 1272 - protein, 16 aa, synthetic construct
  REGION 1..16: note = Synthetic peptide
RSSQSLLHSNRFNYLD

SEQ ID NO: 1273 - protein, 7 aa, synthetic construct
  REGION 1..7: note = Synthetic peptide
LGSNRAS

SEQ ID NO: 1274 - protein, 9 aa, synthetic construct
  REGION 1..9: note = Synthetic peptide
MQALQTPLT

SEQ ID NO: 1275 - protein, 122 aa, synthetic construct
  REGION 1..122: note = Synthetic peptide
QVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSS

SEQ ID NO: 1276 - protein, 112 aa, synthetic construct
  REGION 1..112: note = Synthetic peptide
DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIK

SEQ ID NO: 1277 - protein, 249 aa, synthetic construct
  REGION 1..249: note = Synthetic peptide
DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSS

SEQ ID NO: 1278 - protein, 503 aa, synthetic construct
  REGION 1..503: note = Synthetic peptide
DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1279 - protein, 991 aa, synthetic construct
  REGION 1..991: note = Synthetic peptide
DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1280 - protein, 989 aa, synthetic construct
  REGION 1..989: note = Synthetic peptide
DIVMTQSPLSLPVTPGEPASISCRSSQSLLHSNRFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1281 - protein, 5 aa, synthetic construct
  REGION 1..5: note = Synthetic peptide
SYGIH

SEQ ID NO: 1282 - protein, 17 aa, synthetic construct
  REGION 1..17: note = Synthetic peptide
LTSYEGGNKYYAESVKG

SEQ ID NO: 1283 - protein, 13 aa, synthetic construct
  REGION 1..13: note = Synthetic peptide
DRGTIFGDYGMDV

SEQ ID NO: 1284 - protein, 16 aa, synthetic construct
  REGION 1..16: note = Synthetic peptide
RSSQSLLHKNAFNYLD

SEQ ID NO: 1285 - protein, 7 aa, synthetic construct
  REGION 1..7: note = Synthetic peptide
LGSNRAS

SEQ ID NO: 1286 - protein, 9 aa, synthetic construct
  REGION 1..9: note = Synthetic peptide
MQALQTPFT

SEQ ID NO: 1287 - protein, 122 aa, synthetic construct
  REGION 1..122: note = Synthetic peptide
QVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1288 - protein, 112 aa, synthetic construct
  REGION 1..112: note = Synthetic peptide
DIVMTQSPLSLPVTPGEPASISCRSSQSLLHKNAFNYLDWYLQKPGQSPQLLIYLGSNRASGVPDRFSGSGSGTDFTLKISRVEAEDVGVYYCMQALQTPFTFGCGTKVEIK

SEQ ID NO: 1289 - protein, 249 aa, synthetic construct
  REGION 1..249: note = Synthetic peptide
DIVMTQSPLSLPVTPGEPASISCRSSQSLLHKNAFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1290 - protein, 503 aa, synthetic construct
  REGION 1..503: note = Synthetic peptide
DIVMTQSPLSLPVTPGEPASISCRSSQSLLHKNAFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1291 - protein, 991 aa, synthetic construct
  REGION 1..991: note = Synthetic peptide
DIVMTQSPLSLPVTPGEPASISCRSSQSLLHKNAFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1292 - protein, 989 aa, synthetic construct
  REGION 1..989: note = Synthetic peptide
DIVMTQSPLSLPVTPGEPASISCRSSQSLLHKNAFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1293 - protein, 5 aa, synthetic construct
  REGION 1..5: note = Synthetic peptide
SYGIH

SEQ ID NO: 1294 - protein, 17 aa, synthetic construct
  REGION 1..17: note = Synthetic peptide
LTSYEGGNKYYAESVKG

SEQ ID NO: 1295 - protein, 13 aa, synthetic construct
  REGION 1..13: note = Synthetic peptide
DRGTIFGDYGMDV

SEQ ID NO: 1296 - protein, 16 aa, synthetic construct
  REGION 1..16: note = Synthetic peptide
RSSQSLLHQNRFNYLD

SEQ ID NO: 1297 - protein, 7 aa, synthetic construct
  REGION 1..7: note = Synthetic peptide
LGSNRAS

SEQ ID NO: 1298 - protein, 9 aa, synthetic construct
  REGION 1..9: note = Synthetic peptide
MQALQTPFT

SEQ ID NO: 1299 - protein, 122 aa, synthetic construct; identical to SEQ ID NO: 1287
  REGION 1..122: note = Synthetic peptide

SEQ ID NO: 1300 - protein, 112 aa, synthetic construct
  REGION 1..112: note = Synthetic peptide
DIVMTQSPLSLPVTPGEPASISCRSSQSLLHQNRFNYLDWYLQKPGQSPQLLIYLGSNRASGVPDRFSGSGSGTDFTLKISRVEAEDVGVYYCMQALQTPFTFGCGTKVEIK

SEQ ID NO: 1301 - protein, 249 aa, synthetic construct
  REGION 1..249: note = Synthetic peptide
DIVMTQSPLSLPVTPGEPASISCRSSQSLLHQNRFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1302 - protein, 503 aa, synthetic construct
  REGION 1..503: note = Synthetic peptide
DIVMTQSPLSLPVTPGEPASISCRSSQSLLHQNRFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1303 - protein, 991 aa, synthetic construct
  REGION 1..991: note = Synthetic peptide
DIVMTQSPLSLPVTPGEPASISCRSSQSLLHQNRFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1304 - protein, 989 aa, synthetic construct
  REGION 1..989: note = Synthetic peptide
DIVMTQSPLSLPVTPGEPASISCRSSQSLLHQNRFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1305 - protein, 5 aa, synthetic construct
  REGION 1..5: note = Synthetic peptide
SYGIH

SEQ ID NO: 1306 - protein, 17 aa, synthetic construct
  REGION 1..17: note = Synthetic peptide
LTSYEGGNKYYAESVKG

SEQ ID NO: 1307 - protein, 13 aa, synthetic construct
  REGION 1..13: note = Synthetic peptide
DRGTIFGDYGMEV

SEQ ID NO: 1308 - protein, 16 aa, synthetic construct
  REGION 1..16: note = Synthetic peptide
RSSQSLLHPNKLNYLD

SEQ ID NO: 1309 - protein, 7 aa, synthetic construct
  REGION 1..7: note = Synthetic peptide
LGSNRAS

SEQ ID NO: 1310 - protein, 9 aa, synthetic construct
  REGION 1..9: note = Synthetic peptide
MQALQTPFT

SEQ ID NO: 1311 - protein, 122 aa, synthetic construct
  REGION 1..122: note = Synthetic peptide
QVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMEVWGQGTTVTVSS

SEQ ID NO: 1312 - protein, 112 aa, synthetic construct
  REGION 1..112: note = Synthetic peptide
DIVMTQSPLSLPVTPGEPASISCRSSQSLLHPNKLNYLDWYMQKPGQSPQLLIYLGSNRASGVPDRFSGSGSGTDFTLKISRVEAEDVGVYYCMQALQTPFTFGCGTKVEIK

SEQ ID NO: 1313 - protein, 249 aa, synthetic construct
  REGION 1..249: note = Synthetic peptide
DIVMTQSPLSLPVTPGEPASISCRSSQSLLHPNKLNYLDWYMQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMEVWGQGTTVTVSS

SEQ ID NO: 1314 - protein, 503 aa, synthetic construct
  REGION 1..503: note = Synthetic peptide
DIVMTQSPLSLPVTPGEPASISCRSSQSLLHPNKLNYLDWYMQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1315 - protein, 991 aa, synthetic construct
  REGION 1..991: note = Synthetic peptide
DIVMTQSPLSLPVTPGEPASISCRSSQSLLHPNKLNYLDWYMQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1316 - protein, 989 aa, synthetic construct
  REGION 1..989: note = Synthetic peptide
DIVMTQSPLSLPVTPGEPASISCRSSQSLLHPNKLNYLDWYMQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1317 - protein, 5 aa, synthetic construct
  REGION 1..5: note = Synthetic peptide
SYGIH

SEQ ID NO: 1318 - protein, 17 aa, synthetic construct
  REGION 1..17: note = Synthetic peptide
LTSYEGGNKYYAESVKG

SEQ ID NO: 1319 - protein, 13 aa, synthetic construct
  REGION 1..13: note = Synthetic peptide
DRGTIFGDYGMDV

SEQ ID NO: 1320 - protein, 16 aa, synthetic construct
  REGION 1..16: note = Synthetic peptide
RSSQSLLHKNRFNYLD

SEQ ID NO: 1321 - protein, 7 aa, synthetic construct
  REGION 1..7: note = Synthetic peptide
LGSNRAS

SEQ ID NO: 1322 - protein, 9 aa, synthetic construct
  REGION 1..9: note = Synthetic peptide
MQALQTPFT

SEQ ID NO: 1323 - protein, 122 aa, synthetic construct; identical to SEQ ID NO: 1287
  REGION 1..122: note = Synthetic peptide

SEQ ID NO: 1324 - protein, 112 aa, synthetic construct
  REGION 1..112: note = Synthetic peptide
DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIK

SEQ ID NO: 1325 - protein, 249 aa, synthetic construct
  REGION 1..249: note = Synthetic peptide
DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1326 - protein, 503 aa, synthetic construct
  REGION 1..503: note = Synthetic peptide
DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1327 - protein, 991 aa, synthetic construct
  REGION 1..991: note = Synthetic peptide
DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1328 - protein, 989 aa, synthetic construct
  REGION 1..989: note = Synthetic peptide
DIVMTQSPLSLPVTPGEPASISCRSSQSLLHKNRFNYLDWYVQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1329 - protein, 5 aa, synthetic construct
  REGION 1..5: note = Synthetic peptide
SYGIH

SEQ ID NO: 1330 - protein, 17 aa, synthetic construct
  REGION 1..17: note = Synthetic peptide
LTSYEGGNKYYAESVKG

SEQ ID NO: 1331 - protein, 13 aa, synthetic construct
  REGION 1..13: note = Synthetic peptide
DRGTIFGDYGMDV

SEQ ID NO: 1332 - protein, 16 aa, synthetic construct
  REGION 1..16: note = Synthetic peptide
RSSQSLLHRNSWNYLD

SEQ ID NO: 1333 - protein, 7 aa, synthetic construct
  REGION 1..7: note = Synthetic peptide
LGSNRAS

SEQ ID NO: 1334 - protein, 9 aa, synthetic construct
  REGION 1..9: note = Synthetic peptide
MQALQTPFT

SEQ ID NO: 1335 - protein, 122 aa, synthetic construct; identical to SEQ ID NO: 1287
  REGION 1..122: note = Synthetic peptide

SEQ ID NO: 1336 - protein, 112 aa, synthetic construct
  REGION 1..112: note = Synthetic peptide
DIVMTQSPLSLPVTPGEPASISCRSSQSLLHRNSWNYLDWYLQKPGQSPQLLIYLGSNRASGVPDRFSGSGSGTDFTLKISRVEAEDVGVYYCMQALQTPFTFGCGTKVEIK

SEQ ID NO: 1337 - protein, 249 aa, synthetic construct
  REGION 1..249: note = Synthetic peptide
DIVMTQSPLSLPVTPGEPASISCRSSQSLLHRNSWNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1338 - protein, 503 aa, synthetic construct
  REGION 1..503: note = Synthetic peptide
DIVMTQSPLSLPVTPGEPASISCRSSQSLLHRNSWNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1339 - protein, 991 aa, synthetic construct
  REGION 1..991: note = Synthetic peptide
DIVMTQSPLSLPVTPGEPASISCRSSQSLLHRNSWNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1340 - protein, 989 aa, synthetic construct
  REGION 1..989: note = Synthetic peptide
DIVMTQSPLSLPVTPGEPASISCRSSQSLLHRNSWNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1341 - protein, 5 aa, synthetic construct
  REGION 1..5: note = Synthetic peptide
SYGIH

SEQ ID NO: 1342 - protein, 17 aa, synthetic construct
  REGION 1..17: note = Synthetic peptide
LTSYEGGNKYYAESVKG

SEQ ID NO: 1343 - protein, 13 aa, synthetic construct
  REGION 1..13: note = Synthetic peptide
DRGTIFGDYGMDV

SEQ ID NO: 1344 - protein, 16 aa, synthetic construct
  REGION 1..16: note = Synthetic peptide
RSSQSLLHPNHFNYLD

SEQ ID NO: 1345 - protein, 7 aa, synthetic construct
  REGION 1..7: note = Synthetic peptide
LGSNRAS

SEQ ID NO: 1346 - protein, 9 aa, synthetic construct
  REGION 1..9: note = Synthetic peptide
MQALQTPFT

SEQ ID NO: 1347 - protein, 122 aa, synthetic construct; identical to SEQ ID NO: 1287
  REGION 1..122: note = Synthetic peptide

SEQ ID NO: 1348 - protein, 112 aa, synthetic construct
  REGION 1..112: note = Synthetic peptide
DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIK

SEQ ID NO: 1349 - protein, 249 aa, synthetic construct
  REGION 1..249: note = Synthetic peptide
DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1350 - protein, 503 aa, synthetic construct
  REGION 1..503: note = Synthetic peptide
DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1351 - protein, 991 aa, synthetic construct
  REGION 1..991: note = Synthetic peptide
DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1352 - protein, 989 aa, synthetic construct
  REGION 1..989: note = Synthetic peptide
DIVMTQSPLSLPVTPGEPASISCRSSQSLLHPNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1353 - protein, 5 aa, synthetic construct
  REGION 1..5: note = Synthetic peptide
SYGIH

SEQ ID NO: 1354 - protein, 17 aa, synthetic construct
  REGION 1..17: note = Synthetic peptide
LTSYEGGNKYYAESVKG

SEQ ID NO: 1355 - protein, 13 aa, synthetic construct
  REGION 1..13: note = Synthetic peptide
DRGTIFGDYGMDV

SEQ ID NO: 1356 - protein, 16 aa, synthetic construct
  REGION 1..16: note = Synthetic peptide
RSSQSLLHKNSFNYLD

SEQ ID NO: 1357 - protein, 7 aa, synthetic construct
  REGION 1..7: note = Synthetic peptide
LGSNRAS

SEQ ID NO: 1358 - protein, 9 aa, synthetic construct
  REGION 1..9: note = Synthetic peptide
MQALQTPFT

SEQ ID NO: 1359 - protein, 122 aa, synthetic construct; identical to SEQ ID NO: 1287
  REGION 1..122: note = Synthetic peptide

SEQ ID NO: 1360 - protein, 112 aa, synthetic construct
  REGION 1..112: note = Synthetic peptide
DIVMTQSPLSLPVTPGEPASISCRSSQSLLHKNSFNYLDWYLQKPGQSPQLLIYLGSNRASGVPDRFSGSGSGTDFTLKISRVEAEDVGVYYCMQALQTPFTFGCGTKVEIK

SEQ ID NO: 1361 - protein, 249 aa, synthetic construct
  REGION 1..249: note = Synthetic peptide
DIVMTQSPLSLPVTPGEPASISCRSSQSLLHKNSFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1362 - protein, 503 aa, synthetic construct
  REGION 1..503: note = Synthetic peptide
DIVMTQSPLSLPVTPGEPASISCRSSQSLLHKNSFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1363 - protein, 991 aa, synthetic construct
  REGION 1..991: note = Synthetic peptide
DIVMTQSPLSLPVTPGEPASISCRSSQSLLHKNSFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1364 - protein, 989 aa, synthetic construct
  REGION 1..989: note = Synthetic peptide
DIVMTQSPLSLPVTPGEPASISCRSSQSLLHKNSFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1365 - protein, 5 aa, synthetic construct
  REGION 1..5: note = Synthetic peptide
SYGIH

SEQ ID NO: 1366 - protein, 17 aa, synthetic construct
  REGION 1..17: note = Synthetic peptide
LTSYEGGNKYYAESVKG

SEQ ID NO: 1367 - protein, 13 aa, synthetic construct
  REGION 1..13: note = Synthetic peptide
DRGTIFGDYGMDV

SEQ ID NO: 1368 - protein, 16 aa, synthetic construct
  REGION 1..16: note = Synthetic peptide
RSSQSLLHKNHFNYLD

SEQ ID NO: 1369 - protein, 7 aa, synthetic construct
  REGION 1..7: note = Synthetic peptide
LGSNRAS

SEQ ID NO: 1370 - protein, 9 aa, synthetic construct
  REGION 1..9: note = Synthetic peptide
MQALQTPFT

SEQ ID NO: 1371 - protein, 122 aa, synthetic construct; identical to SEQ ID NO: 1287
  REGION 1..122: note = Synthetic peptide

SEQ ID NO: 1372 - protein, 112 aa, synthetic construct
  REGION 1..112: note = Synthetic peptide
DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIK

SEQ ID NO: 1373 - protein, 249 aa, synthetic construct
  REGION 1..249: note = Synthetic peptide
DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSS

SEQ ID NO: 1374 - protein, 503 aa, synthetic construct
  REGION 1..503: note = Synthetic peptide
DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1375 - protein, 991 aa, synthetic construct
  REGION 1..991: note = Synthetic peptide
DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1376 - protein, 989 aa, synthetic construct
  REGION 1..989: note = Synthetic peptide
DIVMTQSPLSLPVTPGEPASISCRSSQSLLHKNHFNYLDWYLQKPGQSPQLLIYLGSNRASGVPDRFSGSGSGTDFTLKISRVEAEDVGVYYCMQALQTPFTFGCGTKVEIKGGGGSGGGGSGGGGSQVQLVESGGGVVQPGRSLRLSCAASGFTFSSYGIHWVRQAPGKCLEWVALTSYEGGNKYYAESVKGRFTISRDNSKNTLYLQMNSLRAEDTAVYYCAKDRGTIFGDYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1377 - protein, 5 aa, synthetic construct
  REGION 1..5: note = Synthetic peptide
NYGMH

SEQ ID NO: 1378 - protein, 17 aa, synthetic construct
  REGION 1..17: note = Synthetic peptide
VMSWEGSNKYYAEPVKG

SEQ ID NO: 1379 - protein, 13 aa, synthetic construct
  REGION 1..13: note = Synthetic peptide
DRGTIFGYYGMDV

SEQ ID NO: 1380 - protein, 16 aa, synthetic construct
  REGION 1..16: note = Synthetic peptide
RSSQSLLHKNNFNYLD

SEQ ID NO: 1381 - protein, 7 aa, synthetic construct
  REGION 1..7: note = Synthetic peptide
LGSNRAS

SEQ ID NO: 1382 - protein, 9 aa, synthetic construct
  REGION 1..9: note = Synthetic peptide
MQALQTPLT

SEQ ID NO: 1383 - protein, 122 aa, synthetic construct
  REGION 1..122: note = Synthetic peptide
QVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSS

SEQ ID NO: 1384 - protein, 112 aa, synthetic construct
  REGION 1..112: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIK

SEQ ID NO: 1385 - protein, 249 aa, synthetic construct
  REGION 1..249: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSS

SEQ ID NO: 1386 - protein, 503 aa, synthetic construct
  REGION 1..503: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1387 - protein, 991 aa, synthetic construct
  REGION 1..991: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1388 - protein, 989 aa, synthetic construct
  REGION 1..989: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALQTPLTFACGTKVEIKGGGGSGGGGSGGGGSQVQLVESGGGVVQPGRSLRLSCEASGFIVSNYGMHWVRQAPGKCLEWVAVMSWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1389 - protein, 5 aa, synthetic construct
  REGION 1..5: note = Synthetic peptide
SYGMH

SEQ ID NO: 1390 - protein, 17 aa, synthetic construct
  REGION 1..17: note = Synthetic peptide
VISYEGSNKYYAESVKG

SEQ ID NO: 1391 - protein, 13 aa, synthetic construct
  REGION 1..13: note = Synthetic peptide
DRGTIFGNYGLEV

SEQ ID NO: 1392 - protein, 16 aa, synthetic construct
  REGION 1..16: note = Synthetic peptide
RSSQSLLHGNRFNYLD

SEQ ID NO: 1393 - protein, 7 aa, synthetic construct
  REGION 1..7: note = Synthetic peptide
LGSNRAS

SEQ ID NO: 1394 - protein, 9 aa, synthetic construct
  REGION 1..9: note = Synthetic peptide
MQALQTPFT

SEQ ID NO: 1395 - protein, 122 aa, synthetic construct
  REGION 1..122: note = Synthetic peptide
QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 1396 - protein, 112 aa, synthetic construct
  REGION 1..112: note = Synthetic peptide
DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIK

SEQ ID NO: 1397 - protein, 249 aa, synthetic construct
  REGION 1..249: note = Synthetic peptide
DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 1398 - protein, 503 aa, synthetic construct
  REGION 1..503: note = Synthetic peptide
DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1399 - protein, 991 aa, synthetic construct
  REGION 1..991: note = Synthetic peptide
DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1400 - protein, 989 aa, synthetic construct
  REGION 1..989: note = Synthetic peptide
DIVMTQSPLSLPVISGEPASISCRSSQSLLHGNRFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1401 - protein, 5 aa, synthetic construct
  REGION 1..5: note = Synthetic peptide
SYGMH

SEQ ID NO: 1402 - protein, 17 aa, synthetic construct
  REGION 1..17: note = Synthetic peptide
VISYEGSNKYYAESVKG

SEQ ID NO: 1403 - protein, 13 aa, synthetic construct
  REGION 1..13: note = Synthetic peptide
DRGTIFGNYGLEV

SEQ ID NO: 1404 - protein, 16 aa, synthetic construct
  REGION 1..16: note = Synthetic peptide
RSSQSLLHKNAFNYLD

SEQ ID NO: 1405 - protein, 7 aa, synthetic construct
  REGION 1..7: note = Synthetic peptide
LGSNRAS

SEQ ID NO: 1406 - protein, 9 aa, synthetic construct
  REGION 1..9: note = Synthetic peptide
MQALQTPFT

SEQ ID NO: 1407 - protein, 122 aa, synthetic construct; identical to SEQ ID NO: 1395
  REGION 1..122: note = Synthetic peptide

SEQ ID NO: 1408 - protein, 112 aa, synthetic construct
  REGION 1..112: note = Synthetic peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIK

SEQ ID NO: 1409 - protein, 249 aa, synthetic construct
  REGION 1..249: note = Synthetic peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 1410 - protein, 503 aa, synthetic construct
  REGION 1..503: note = Synthetic peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1411 - protein, 991 aa, synthetic construct
  REGION 1..991: note = Synthetic peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1412 - protein, 989 aa, synthetic construct
  REGION 1..989: note = Synthetic peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1413 - protein, 5 aa, synthetic construct
  REGION 1..5: note = Synthetic peptide
SYGMH

SEQ ID NO: 1414 - protein, 17 aa, synthetic construct
  REGION 1..17: note = Synthetic peptide
VISYEGSNKYYAESVKG

SEQ ID NO: 1415 - protein, 13 aa, synthetic construct
  REGION 1..13: note = Synthetic peptide
DRGTIFGNYGLEV

SEQ ID NO: 1416 - protein, 16 aa, synthetic construct
  REGION 1..16: note = Synthetic peptide
RSSQSLLHKNKWNYLD

SEQ ID NO: 1417 - protein, 7 aa, synthetic construct
  REGION 1..7: note = Synthetic peptide
LGSNRAS

SEQ ID NO: 1418 - protein, 9 aa, synthetic construct
  REGION 1..9: note = Synthetic peptide
MQALQTPFT

SEQ ID NO: 1419 - protein, 122 aa, synthetic construct; identical to SEQ ID NO: 1395
  REGION 1..122: note = Synthetic peptide

SEQ ID NO: 1420 - protein, 112 aa, synthetic construct
  REGION 1..112: note = Synthetic peptide
DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIK

SEQ ID NO: 1421 - protein, 249 aa, synthetic construct
  REGION 1..249: note = Synthetic peptide
DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 1422 - protein, 503 aa, synthetic construct
  REGION 1..503: note = Synthetic peptide
DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1423 - protein, 991 aa, synthetic construct
  REGION 1..991: note = Synthetic peptide
DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1424 - protein, 989 aa, synthetic construct
  REGION 1..989: note = Synthetic peptide
DIVMTQSPLSLPVISGEPASISCRSSQSLLHKNKWNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1425 - protein, 5 aa, synthetic construct
  REGION 1..5: note = Synthetic peptide
SYGMH

SEQ ID NO: 1426 - protein, 17 aa, synthetic construct
  REGION 1..17: note = Synthetic peptide
VISYEGSNKYYAESVKG

SEQ ID NO: 1427 - protein, 13 aa, synthetic construct
  REGION 1..13: note = Synthetic peptide
DRGTIFGNYGLEV

SEQ ID NO: 1428 - protein, 16 aa, synthetic construct
  REGION 1..16: note = Synthetic peptide
RSSQSLLHKNNFNYLD

SEQ ID NO: 1429 - protein, 7 aa, synthetic construct
  REGION 1..7: note = Synthetic peptide
LGSNRAS

SEQ ID NO: 1430 - protein, 9 aa, synthetic construct
  REGION 1..9: note = Synthetic peptide
MQALQTPFT

SEQ ID NO: 1431 - protein, 122 aa, synthetic construct; identical to SEQ ID NO: 1395
  REGION 1..122: note = Synthetic peptide

SEQ ID NO: 1432 - protein, 112 aa, synthetic construct
  REGION 1..112: note = Synthetic peptide
DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIK

SEQ ID NO: 1433 - protein, 249 aa, synthetic construct
  REGION 1..249: note = Synthetic peptide
DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 1434 - protein, 503 aa, synthetic construct
  REGION 1..503: note = Synthetic peptide
DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1435 - protein, 991 aa, synthetic construct
  REGION 1..991: note = Synthetic peptide
DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1436 - protein, 989 aa, synthetic construct
  REGION 1..989: note = Synthetic peptide
DIVMTQSPLSLPVISGEPASISCRSSQSLLHKNNFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1437 - protein, 5 aa, synthetic construct
  REGION 1..5: note = Synthetic peptide
NYGMH

SEQ ID NO: 1438 - protein, 17 aa, synthetic construct
  REGION 1..17: note = Synthetic peptide
AIGWEGSNKYYAEPVKG

SEQ ID NO: 1439 - protein, 13 aa, synthetic construct
  REGION 1..13: note = Synthetic peptide
DRGTIFGYYGMDV

SEQ ID NO: 1440 - protein, 16 aa, synthetic construct
  REGION 1..16: note = Synthetic peptide
RSSQSLLHKNNFNYLD

SEQ ID NO: 1441 - protein, 7 aa, synthetic construct
  REGION 1..7: note = Synthetic peptide
LGSNRAS

SEQ ID NO: 1442 - protein, 9 aa, synthetic construct
  REGION 1..9: note = Synthetic peptide
MQALSEPLT

SEQ ID NO: 1443 - protein, 122 aa, synthetic construct; identical to SEQ ID NO: 1275
  REGION 1..122: note = Synthetic peptide

SEQ ID NO: 1444 - protein, 112 aa, synthetic construct
  REGION 1..112: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIK

SEQ ID NO: 1445 - protein, 249 aa, synthetic construct
  REGION 1..249: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSS

SEQ ID NO: 1446 - protein, 503 aa, synthetic construct
  REGION 1..503: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1447 - protein, 991 aa, synthetic construct
  REGION 1..991: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1448 - protein, 989 aa, synthetic construct
  REGION 1..989: note = Synthetic peptide
DIVMTQSPLSLPVTPGEPASISCRSSQSLLHKNNFNYLDWYLQKPGQSPQLLIYLGSNRASGVPDRFSGSGSGTDFTLKISRVEAEDVGVYYCMQALSEPLTFACGTKVEIKGGGGSGGGGSGGGGSQVQLVESGGGVVQPGRSLRLSCEASGFIVSNYGMHWVRQAPGKCLEWVAAIGWEGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1449 - protein, 10 aa, synthetic construct
  REGION 1..10: note = Synthetic peptide
DKTHTCPPCP

SEQ ID NO: 1450 - protein, 12 aa, synthetic construct
  REGION 1..12: note = Synthetic peptide
ERKCCVECPPCP

SEQ ID NO: 1451 - protein, 16 aa, synthetic construct
  REGION 1..16: note = Synthetic peptide
ELKTPLDTTHTCPRCP

SEQ ID NO: 1452 - protein, 12 aa, synthetic construct
  REGION 1..12: note = Synthetic peptide
ESKYGPPCPSCP

SEQ ID NO: 1453 - protein, 994 aa, synthetic construct; identical to SEQ ID NO: 78
  REGION 1..994: note = Synthetic peptide

SEQ ID NO: 1454 - protein, 984 aa, synthetic construct
  REGION 1..984: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1455 - protein, 1004 aa, synthetic construct
  REGION 1..1004: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1456 - protein, 994 aa, synthetic construct
  REGION 1..994: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGGGGSGGGGSGGGGSGGGGSAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1457 - protein, 984 aa, synthetic construct
  REGION 1..984: note = Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGGGGSGGGGSGGGGSGGGGSAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1458 - protein, 17 aa, synthetic construct
  REGION 1..17: note = Synthetic peptide
ELKTPLGDTTHTCPRCP

SEQ ID NO: 1459 - protein, 15 aa, synthetic construct
  REGION 1..15: note = Synthetic peptide
EPKSCDKTHTCPPCP

SEQ ID NO: 1460 - protein, 249 aa, synthetic construct
  REGION 1..249: note = Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1461 - protein, 249 aa, synthetic construct
  REGION 1..249: note = Synthetic peptide
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1462 - protein, 249 aa, synthetic construct
  REGION 1..249: note = Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1463 - protein, 249 aa, synthetic construct
  REGION 1..249: note = Synthetic peptide
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1464 - protein, 249 aa, synthetic construct
  REGION 1..249: note = Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1465 - protein, 249 aa, synthetic construct
  REGION 1..249: note = Synthetic peptide
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1466 - protein, 249 aa, synthetic construct
  REGION 1..249: note = Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1467 - protein, 249 aa, synthetic construct
  REGION 1..249: note = Synthetic peptide
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1468 - protein, 249 aa, synthetic construct
  REGION 1..249: note = Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 1469 - protein, 249 aa, synthetic construct
  REGION 1..249: note = Synthetic peptide
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 1470 - protein, 249 aa, synthetic construct
  REGION 1..249: note = Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1471 - protein, 249 aa, synthetic construct
  REGION 1..249: note = Synthetic peptide
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1472 - protein, 249 aa, synthetic construct
  REGION 1..249: note = Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 1473 - protein, 249 aa, synthetic construct
  REGION 1..249: note = Synthetic peptide
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 1474 - protein, 249 aa, synthetic construct
  REGION 1..249: note = Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1475 - protein, 249 aa, synthetic construct
  REGION 1..249: note = Synthetic peptide
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1476 - protein, 249 aa, synthetic construct
  REGION 1..249: note = Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1477 - protein, 249 aa, synthetic construct
  REGION 1..249: note = Synthetic peptide
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1478 - protein, 249 aa, synthetic construct
  REGION 1..249: note = Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1479 - protein, 249 aa, synthetic construct
  REGION 1..249: note = Synthetic peptide
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1480 - protein, 5 aa, synthetic construct
  REGION 1..5: note = unknown organism
IYAMN

SEQ ID NO: 1481 - protein, 19 aa, synthetic construct
  REGION 1..19: note = unknown organism
RIRSKYNNYATYYADSVKS

SEQ ID NO: 1482 - protein, 14 aa, synthetic construct
  REGION 1..14: note = unknown organism
HGNFGNSYVSFFAY

SEQ ID NO: 1483 - protein, 5 aa, synthetic construct
  REGION 1..5: note = unknown organism
KYAMN

SEQ ID NO: 1484 - protein, 19 aa, synthetic construct
  REGION 1..19: note = unknown organism
RIRSKYNNYATYYADSVKD

SEQ ID NO: 1485 - protein, 14 aa, synthetic construct
  REGION 1..14: note = unknown organism
HGNFGNSYISYWAY

SEQ ID NO: 1486 - protein, 5 aa, synthetic construct
  REGION 1..5: note = unknown organism
SYAMN

SEQ ID NO: 1487 - protein, 19 aa, synthetic construct
  REGION 1..19: note = unknown organism
RIRSKYNNYATYYADSVKG

SEQ ID NO: 1488 - protein, 14 aa, synthetic construct
  REGION 1..14: note = unknown organism
HGNFGNSYLSFWAY

SEQ ID NO: 1489 - protein, 5 aa, synthetic construct
  REGION 1..5: note = unknown organism
RYAMN

SEQ ID NO: 1490 - protein, 19 aa, synthetic construct
  REGION 1..19: note = unknown organism
RIRSKYNNYATYYADSVKG

SEQ ID NO: 1491 - protein, 14 aa, synthetic construct
  REGION 1..14: note = unknown organism
HGNFGNSYLSYFAY

SEQ ID NO: 1492 - protein, 5 aa, synthetic construct
  REGION 1..5: note = unknown organism
VYAMN

SEQ ID NO: 1493 - protein, 19 aa, synthetic construct
  REGION 1..19: note = unknown organism
RIRSKYNNYATYYADSVKK

SEQ ID NO: 1494 - protein, 14 aa, synthetic construct
  REGION 1..14: note = unknown organism
HGNFGNSYLSWWAY

SEQ ID NO: 1495 - protein, 5 aa, synthetic construct
  REGION 1..5: note = unknown organism
KYAMN

SEQ ID NO: 1496 - protein, 19 aa, synthetic construct
  REGION 1..19: note = unknown organism
RIRSKYNNYATYYADSVKS

SEQ ID NO: 1497 - protein, 14 aa, synthetic construct
  REGION 1..14: note = unknown organism
HGNFGNSYTSYYAY

SEQ ID NO: 1498 - protein, 5 aa, synthetic construct
  REGION 1..5: note = unknown organism
GYAMN

SEQ ID NO: 1499 - protein, 19 aa, synthetic construct
  REGION 1..19: note = unknown organism
RIRSKYNNYATYYADSVKE

SEQ ID NO: 1500 - protein, 14 aa, synthetic construct
  REGION 1..14: note = unknown organism
HRNFGNSYLSWFAY

SEQ ID NO: 1501 - protein, 5 aa, synthetic construct
  REGION 1..5: note = unknown organism
VYAMN

SEQ ID NO: 1502 - protein, 19 aa, synthetic construct
  REGION 1..19: note = unknown organism
RIRSKYNNYATYYADSVKK

SEQ ID NO: 1503 - protein, 14 aa, synthetic construct
  REGION 1..14: note = unknown organism
HGNFGNSYISWWAY

SEQ ID NO: 1504 - protein, 5 aa, synthetic construct
  REGION 1..5: note = unknown organism
SYAMN

SEQ ID NO: 1505 - protein, 19 aa, synthetic construct
  REGION 1..19: note = unknown organism
RIRSKYNNYATYYADSVKG

SEQ ID NO: 1506 - protein, 14 aa, synthetic construct
  REGION 1..14: note = unknown organism
HGNFGNSYVSWWAY

SEQ ID NO: 1507 - protein, 5 aa, synthetic construct
  REGION 1..5: note = unknown organism
KYAMN

SEQ ID NO: 1508 - protein, 19 aa, synthetic construct
  REGION 1..19: note = unknown organism
RIRSKYNNYATYYADSVKD

SEQ ID NO: 1509 - protein, 14 aa, synthetic construct
  REGION 1..14: note = unknown organism
HGNFGNSYISYWAY

SEQ ID NO: 1510 - protein, 14 aa, synthetic construct
  REGION 1..14: note = unknown organism
GSSTGAVTSGYYPN

SEQ ID NO: 1511 - protein, 7 aa, synthetic construct
  REGION 1..7: note = unknown organism
GTKFLAP

SEQ ID NO: 1512 - protein, 9 aa, synthetic construct
  REGION 1..9: note = unknown organism
ALWYSNRWV

SEQ ID NO: 1513 - protein, 14 aa, synthetic construct
  REGION 1..14: note = unknown organism
RSSTGAVTSGYYPN

SEQ ID NO: 1514 - protein, 7 aa, synthetic construct
  REGION 1..7: note = unknown organism
ATDMRPS

SEQ ID NO: 1515 - protein, 9 aa, synthetic construct
  REGION 1..9: note = unknown organism
ALWYSNRWV

SEQ ID NO: 1516 - protein, 14 aa, synthetic construct
  REGION 1..14: note = unknown organism
GSSTGAVTSGNYPN

SEQ ID NO: 1517 - protein, 7 aa, synthetic construct
  REGION 1..7: note = unknown organism
GTKFLAP

SEQ ID NO: 1518 - protein, 9 aa, synthetic construct
  REGION 1..9: note = unknown organism
VLWYSNRWV

SEQ ID NO: 1519 - protein, 125 aa, synthetic construct
  REGION 1..125: note = unknown organism
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 1520 - protein, 125 aa, synthetic construct
  REGION 1..125: note = unknown organism
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 1521 - protein, 125 aa, synthetic construct
  REGION 1..125: note = unknown organism
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 1522 - protein, 125 aa, synthetic construct
  REGION 1..125: note = unknown organism
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 1523 - protein, 125 aa, synthetic construct
  REGION 1..125: note = unknown organism
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 1524 - protein, 125 aa, synthetic construct
  REGION 1..125: note = unknown organism
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 1525 - protein, 125 aa, synthetic construct
  REGION 1..125: note = unknown organism
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 1526 - protein, 125 aa, synthetic construct
  REGION 1..125: note = unknown organism
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 1527 - protein, 125 aa, synthetic construct
  REGION 1..125: note = unknown organism
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 1528 - protein, 125 aa, synthetic construct
  REGION 1..125: note = unknown organism
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 1529 - protein, 125 aa, synthetic construct
  REGION 1..125: note = unknown organism
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 1530 - protein, 125 aa, synthetic construct
  REGION 1..125: note = unknown organism
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 1531 - protein, 125 aa, synthetic construct
  REGION 1..125: note = unknown organism
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 1532 - protein, 125 aa, synthetic construct
  REGION 1..125: note = unknown organism
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 1533 - protein, 125 aa, synthetic construct
  REGION 1..125: note = unknown organism
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 1534 - protein, 125 aa, synthetic construct
  REGION 1..125: note = unknown organism
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 1535 - protein, 125 aa, synthetic construct
  REGION 1..125: note = unknown organism
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 1536 - protein, 125 aa, synthetic construct
  REGION 1..125: note = unknown organism
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 1537 - protein, 125 aa, synthetic construct; identical to SEQ ID NO: 1521
  REGION 1..125: note = unknown organism

SEQ ID NO: 1538 - protein, 125 aa, synthetic construct; identical to SEQ ID NO: 1522
  REGION 1..125: note = unknown organism

SEQ ID NO: 1539 - protein, 109 aa, synthetic construct
  REGION 1..109: note = unknown organism
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1540 - protein, 109 aa, synthetic construct
  REGION 1..109: note = unknown organism
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 1541 - protein, 109 aa, synthetic construct; identical to SEQ ID NO: 1539
  REGION 1..109: note = unknown organism

SEQ ID NO: 1542 - protein, 109 aa, synthetic construct; identical to SEQ ID NO: 1540
  REGION 1..109: note = unknown organism

SEQ ID NO: 1543 - protein, 109 aa, synthetic construct; identical to SEQ ID NO: 1539
  REGION 1..109: note = unknown organism

SEQ ID NO: 1544 - protein, 109 aa, synthetic construct; identical to SEQ ID NO: 1540
  REGION 1..109: note = unknown organism

SEQ ID NO: 1545 - protein, 109 aa, synthetic construct; identical to SEQ ID NO: 1539
  REGION 1..109: note = unknown organism

SEQ ID NO: 1546 - protein, 109 aa, synthetic construct; identical to SEQ ID NO: 1540
  REGION 1..109: note = unknown organism

SEQ ID NO: 1547 - protein, 109 aa, synthetic construct
  REGION 1..109: note = unknown organism
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 1548 - protein, 109 aa, synthetic construct
  REGION 1..109: note = unknown organism
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 1549 - protein, 109 aa, synthetic construct; identical to SEQ ID NO: 1539
  REGION 1..109: note = unknown organism

SEQ ID NO: 1550 - protein, 109 aa, synthetic construct; identical to SEQ ID NO: 1540
  REGION 1..109: note = unknown organism

SEQ ID NO: 1551 - protein, 109 aa, synthetic construct; identical to SEQ ID NO: 1547
  REGION 1..109: note = unknown organism

SEQ ID NO: 1552 - protein, 109 aa, synthetic construct; identical to SEQ ID NO: 1548
  REGION 1..109: note = unknown organism

SEQ ID NO: 1553 - protein, 109 aa, synthetic construct; identical to SEQ ID NO: 1539
  REGION 1..109: note = unknown organism

SEQ ID NO: 1554 - protein, 109 aa, synthetic construct; identical to SEQ ID NO: 1540
  REGION 1..109: note = unknown organism

SEQ ID NO: 1555 - protein, 109 aa, synthetic construct; identical to SEQ ID NO: 13
  REGION 1..109: note = unknown organism

SEQ ID NO: 1556 - protein, 109 aa, synthetic construct
  REGION 1..109: note = unknown organism
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1557 - protein, 109 aa, synthetic construct; identical to SEQ ID NO: 13
  REGION 1..109: note = unknown organism

SEQ ID NO: 1558 - protein, 109 aa, synthetic construct; identical to SEQ ID NO: 1556
  REGION 1..109: note = unknown organism

The invention claimed is:

1. A single chain antibody construct comprising at least three domains, wherein the antibody construct comprises in an amino to carboxyl order:

a first domain, wherein the first domain is a single chain Fv (scFv) which binds to target cell surface antigen CD19, a first peptide linker, a second domain, wherein the second domain is a single chain Fv (scFv) which binds to an extracellular epitope of the human and/or the *Macaca* CD3ε chain; and wherein the second domain comprises a VL region and a VH region comprising amino acid sequences at least 90% identical to the sequences of a VL region and a VH region selected from the group consisting of:

(a) a VL region comprising SEQ ID NO: 1539 or 1540 and a VH region comprising SEQ ID NO: 1519 or 1520;

(b) a VL region comprising SEQ ID NO: 1541 or 1542 and a VH region comprising SEQ ID NO: 1521 or 1522;

(c) a VL region comprising SEQ ID NO: 1543 or 1544 and a VH region comprising SEQ ID NO: 1523 or 1524;

(d) a VL region comprising SEQ ID NO: 1545 or 1546 and a VH region comprising SEQ ID NO: 1525 or 1526;

(e) a VL region comprising SEQ ID NO: 1547 or 1548 and a VH region comprising SEQ ID NO: 1527 or 1528;

(f) a VL region comprising SEQ ID NO: 1549 or 1550 and a VH region comprising SEQ ID NO: 1529 or 1530;

(g) a VL region comprising SEQ ID NO: 1551 or 1552 and a VH region comprising SEQ ID NO: 1531 or 1532;

(h) a VL region comprising SEQ ID NO: 1553 or 1554 and a VH region comprising SEQ ID NO: 1533 or 1534;

(i) a VL region comprising SEQ ID NO: 1555 or 1556 and a VH region comprising SEQ ID NO: 1535 or 1536; and (j) a VL region comprising SEQ ID NO: 1557 or 1558 and a VH region comprising SEQ ID NO: 1537 or 1538; a second peptide linker, and a third domain, wherein the third domain comprises two polypeptide monomers, each comprising a hinge, a CH2 and a CH3 domain, wherein the two polypeptide monomers are fused to each other via a third peptide linker, wherein the third domain comprises in an amino to carboxyl order:

hinge-CH2-CH3-linker-hinge-CH2-CH3 wherein each of the polypeptide monomers has an amino acid sequence that is at least 90% identical to a sequence selected from the group consisting of SEQ ID NOs: 17, 18, 21, and 22, wherein the glycosylation site at Kabat position 314 of each of the CH2 domains in the third domain is removed by a N314X substitution, wherein X is any amino acid excluding Q, and wherein each of the CH2 domains comprises an intra domain cysteine disulfide bridge by means of the substitutions of Kabat positions V321C and R309C.

2. The antibody construct of claim 1, wherein each of the polypeptide monomers has an amino acid sequence selected from the group consisting of SEQ ID NOs: 17, 18, 21, and 22.

3. The antibody construct of claim 1, wherein the first domain comprises two antibody variable domains and the second domain comprises two antibody variable domains.

4. The antibody construct of claim 1, wherein the second peptide linker has an amino acid sequence selected from the group consisting of SEQ ID NOs: 1, 2, 3, 9, 10, 11 and 12.

5. The antibody construct of claim 1, wherein the antibody construct comprises in an amino to carboxyl order:

(a) the first domain;

(b) the first peptide linker having an amino acid sequence selected from the group consisting of SEQ ID NOs: 1-3;

(c) the second domain;

(d) the second peptide linker having an amino acid sequence selected from the group consisting of SEQ ID NOs: 1, 2, 3, 9, 10, 11 and 12;

(e) the first polypeptide monomer of the third domain;

(f) the third peptide linker having an amino acid sequence selected from the group consisting of SEQ ID NOs: 5, 6, 7 and 8; and (g) the second polypeptide monomer of the third domain.

6. The antibody construct of claim 1, wherein the antibody construct comprises in an amino to carboxyl order:

(a) the first domain having an amino acid sequence selected from the group consisting of SEQ ID NOs: 1277, 1289, 1301, 1313, 1325, 1337, 1349, 1361, 1373, 1385, 1397, 1409, 1421, 1433, and 1445;
(b) the first peptide linker having an amino acid sequence selected from the group consisting of SEQ ID NOs: 1-3;
(c) the second domain having an amino acid sequence selected from the group consisting of SEQ ID NOs: 1460-1479 and 15;
(d) the second peptide linker having an amino acid sequence selected from the group consisting of SEQ ID NOs: 1, 2, 3, 9, 10, 11 and 12;
(e) the first polypeptide monomer of the third domain comprising an amino acid sequence selected from the group consisting of SEQ ID NOs:17, 18, 21, and 22;
(f) the third peptide linker having an amino acid sequence selected from the group consisting of SEQ ID NOs: 5, 6, 7 and 8; and
(g) the second polypeptide monomer of the third domain comprising an amino acid sequence selected from the group consisting of SEQ ID NOs: 17, 18, 21, and 22.

7. The antibody construct of claim 6 comprising an amino acid sequence selected from the group consisting of:

(a) SEQ ID NOs: 252, 306, 257, 307, 268, 308, 273, 309, 284, 310, 289, 311, 300, 312, 305, and 313;

and (b) SEQ ID NOs: 1279, 1280, 1291, 1292, 1303, 1304, 1315, 1316, 1327, 1328, 1339, 1340, 1351, 1352, 1363, 1364, 1375, 1376, 1387, 1388, 1399, 1400, 1411, 1412, 1423, 1424, 1435, 1436, 1447, and 1448.

8. A polynucleotide encoding the antibody construct of claim 1.

9. A vector comprising the polynucleotide of claim 8.

10. A host cell transformed or transfected with the polynucleotide of claim 8.

11. A process for producing a single chain antibody construct, said process comprising culturing the host cell of claim 10 under conditions allowing the expression of the antibody construct, and recovering the antibody construct from the culture.

12. A pharmaceutical composition comprising the antibody construct of claim 1 and a carrier, stabilizer, excipient, diluent, solubilizer, surfactant, emulsifier, preservative or adjuvant.

13. A method of treating or ameliorating a CD19-expressing tumor or CD19-related immunological disorder comprising the step of administering to a subject in need thereof an effective amount of the antibody construct of claim 1.

14. A kit comprising the antibody construct of claim 1 packaged in a container or recipient, and optionally including directions for use.

15. The antibody construct of claim 1, wherein the second domain comprises a scFv region comprising an amino acid sequence selected from the group consisting of: SEQ ID NOs: 1460-1479.

16. A single chain antibody construct comprising the amino acid sequence of SEQ ID NO: 1411.

17. The antibody construct of claim 1, wherein the first domain comprises a VH region comprising complementarity determining regions (CDR) CDR-H1, CDR-H2 and CDR-H3, and a VL region comprising CDR-L1, CDR-L2 and CDR-L3, wherein said CDR-H1, CDR-H2, CDR-H3, CDR-L1, CDR-L2, and CDR-L3 respectively comprise amino acid sequences selected from the group consisting of SEQ ID NOs: 1269-1274, 1281-1286, 1293-1298, 1305-1310, 1317-1322, 1329-1334, 1341-1346, 1353-1358, 1365-1370, 1377-1382, 1389-1394, 1401-1406, 1413-1418, 1425-1430, and 1437-1442.

* * * * *